(12) United States Patent
Facchini

(10) Patent No.: US 10,487,345 B2
(45) Date of Patent: Nov. 26, 2019

(54) METHODS FOR MAKING AND USING POLYNUCLEOTIDE SEQUENCES IN THE SYNTHESIS OF ALKALOID COMPOUNDS

(71) Applicant: EPIMERON INC., Calgary (CA)

(72) Inventor: Peter James Facchini, Calgary (CA)

(73) Assignee: Epimeron Inc., Calgary, Alberta (CA)

( * ) Notice: Subject to any disclaimer, the term of this patent is extended or adjusted under 35 U.S.C. 154(b) by 26 days.

(21) Appl. No.: 15/307,616

(22) PCT Filed: Apr. 27, 2015

(86) PCT No.: PCT/CA2015/050346
§ 371 (c)(1),
(2) Date: Oct. 28, 2016

(87) PCT Pub. No.: WO2015/164960
PCT Pub. Date: Nov. 5, 2015

(65) Prior Publication Data
US 2017/0058305 A1    Mar. 2, 2017

Related U.S. Application Data

(60) Provisional application No. 61/985,742, filed on Apr. 29, 2014, provisional application No. 62/094,376, filed on Dec. 19, 2014.

(51) Int. Cl.
| | | |
|---|---|---|
| *C12P 17/12* | (2006.01) | |
| *C12N 9/02* | (2006.01) | |
| *C12N 1/20* | (2006.01) | |
| *C12N 15/00* | (2006.01) | |
| *C12N 1/14* | (2006.01) | |
| *C07H 21/04* | (2006.01) | |
| *C12N 15/81* | (2006.01) | |
| *C12N 15/10* | (2006.01) | |
| *C12N 15/63* | (2006.01) | |

(Continued)

(52) U.S. Cl.
CPC ............ *C12P 17/12* (2013.01); *C12N 9/0071* (2013.01); *C12N 15/1082* (2013.01); *C12N 15/81* (2013.01); *C12Y 201/01* (2013.01); *C12N 15/1096* (2013.01); *C12N 15/63* (2013.01); *C40B 10/00* (2013.01); *C40B 20/00* (2013.01)

(58) Field of Classification Search
None
See application file for complete search history.

(56) References Cited

U.S. PATENT DOCUMENTS 9,534,241 B2 * 1/2017 Smolke .................... C12P 17/18
2008/0176754 A1 * 7/2008 Smolke .................... C12P 17/12
506/4

OTHER PUBLICATIONS

Desgagne-Penix, I. et al., "Integration of deep transcriptome and proteome analyses reveals the components of alkaloid metabolism in opium poppy cell cultures", BMC Plant Biology, Biomed Central, London, GB, vol. 10, No. 1, p. 252, Nov. 18, 2010.

(Continued)

*Primary Examiner* — Yong D Pak
(74) *Attorney, Agent, or Firm* — Bereskin & Parr LLP/S.E.N.C.R.L.,s.r.l.; Micheline Gravelle

(57) ABSTRACT

Novel methods that may be used for the manufacture of plant alkaloid compounds and novel polynucleotide compounds are provided. The plant alkaloid compounds are useful as medicinal compounds.

Figure 1:
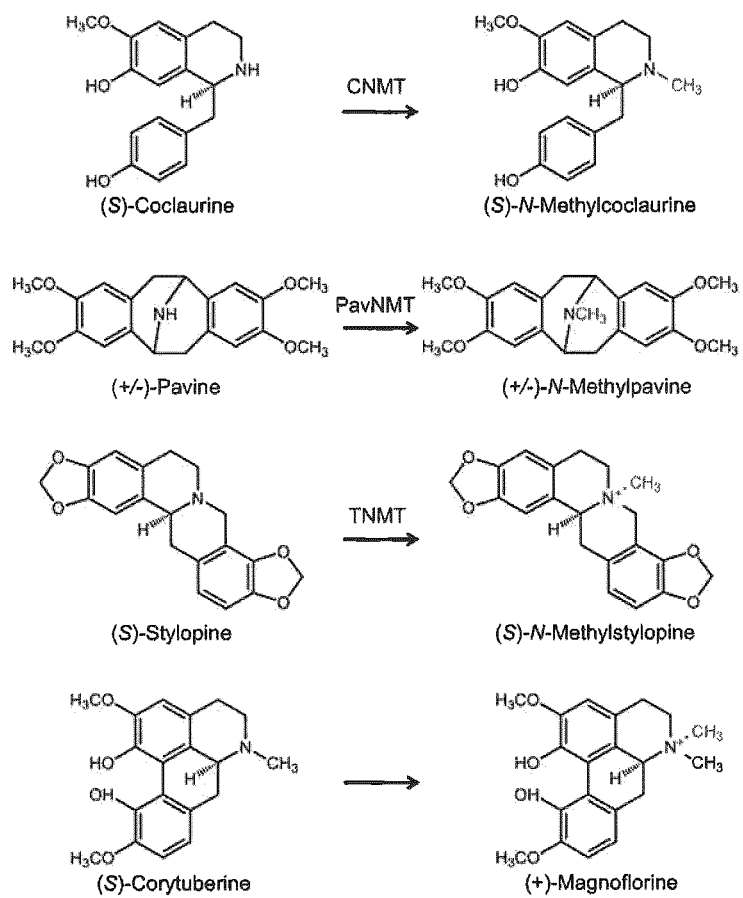

12 Claims, 10 Drawing Sheets
Specification includes a Sequence Listing.

(51) Int. Cl.
    *C40B 10/00*    (2006.01)
    *C40B 20/00*    (2006.01)

(56) References Cited

OTHER PUBLICATIONS

Farrow, S.C. et al., "Transcript and metabolite profiling in cell cultures of 18 plant species that produce benzylisoquinoline alkaloids", Phytochemistry, vol. 77, p. 79-88, Feb. 23, 2012.
Fossati, E. et al., "Reconstitution of a 10-gene pathway for synthesis of the plant alkaloid dihydrosanguinarine in *Saccharomyces cerevisiae*", Nature Communications, vol. 5, p. 1-11, Feb. 11, 2014.
Sato, F. et al., "Microbial production of isoquinoline alkaloide as plant secondary metabolites based on metabolic engineering research", Proceedings of the Japan Academy, Series B, vol. 89, No. 5, p. 165-182, Jan. 1, 2013.
Leonard, E. et al. "Opportunities in metabolic engineering to facilitate scalable alkaloid production", Nature Chemical Biology, vol. 5, No. 5, p. 292-300 (2009).
Xiao, M. et al. "Transcriptome analysis based on next-generation sequencing of non-model plants producing specialized metabolites of biotechnological interest", Journal of Biotechnology, vol. 166, p. 122-134 (2013).

* cited by examiner

ND USING
METHODS FOR MAKING AND USING POLYNUCLEOTIDE SEQUENCES IN THE SYNTHESIS OF ALKALOID COMPOUNDS

RELATED APPLICATIONS

This application is a national phase entry application of Patent Cooperation Treaty Application No. PCT/CA2015/050346, which claims the benefit under 35 USC § 119(e) from U.S. Provisional Patent Application No. 61/985,742 filed on Apr. 29, 2014 and U.S. Provisional Patent Application No. 62/094,376, filed on Dec. 19, 2014, all of which are incorporated by reference herein in their entirety.

FIELD OF THE DISCLOSURE

The compositions and methods disclosed herein relate to alkaloid compounds and to processes for manufacturing the same. More particularly, the present disclosure relates to plant alkaloids, and methods for making such alkaloids using improved polynucleotide sequences.

BACKGROUND OF THE DISCLOSURE

The following paragraphs are provided by way of background to the present disclosure. They are not however an admission that anything discussed therein is prior art or part of the knowledge of persons skilled in the art.

Plants are capable of producing alkaloid compounds in small amounts. In general, these alkaloid compounds are relatively complex organic molecules, containing mostly basic nitrogen atoms. The in planta biosynthesis of an alkaloid compound involves the occurrence of a series of contiguous chemical reactions together constituting a so-called biosynthetic pathway. Each chemical reaction within a biosynthetic pathway is catalyzed by a different plant enzyme, and therefore alkaloid biosynthesis requires that plant enzymes and genes encoding these enzymes, act in concert within the plant cells. Well known examples of plants producing alkaloid compounds, are plants belonging to the Papaveraceae, a plant family constituting approximately 250 species and found mainly in mild and temperate regions of the world. Many alkaloid compounds have been found to have pharmacological effects and have been found useful, as medicinal compounds, as well as recreational drugs or stimulants. Examples of plant alkaloid compounds include the stimulants caffeine and nicotine, the stimulant and local anesthetic cocaine, the anti-malarial drug quinine, the analgesic morphine, the antimicrobials sanguinerine and berberine, the muscle relaxant papaverine and the cough suppressant noscapine.

Currently alkaloid compounds may be harvested from natural sources, such as opium poppy. Alternatively these compounds may be prepared synthetically. The existing manufacturing methods for alkaloid compounds however suffer from low yields and/or are expensive. For example, less than 2% of exogenous (R,S)-norlaudanosoline was converted to sanguinarine via a pathway of 10 genes from opium poppy (*Papaver somniferum*) re-assembled in yeast (*Saccharomyces cerevisiae*) (Fossati et al., 2014). An alternative approach to manufacturing plant alkaloid compounds would comprise marshaling a genetically modified host, e.g. a bacterial or yeast fermentation system, to produce alkaloid compounds. Such a biosynthetic system would permit inexpensive production of plant alkaloids in a tightly controlled environment. However due to the unusual complexity of the synthesis of the vast majority of desirable alkaloid compounds, methods for biosynthesis of alkaloid compounds using inexpensive nutrients and a genetically engineered host system to synthesize alkaloids from such nutrients, are not available. These complexities arise in part from the total number of separate chemical reactions included in a biosynthetic alkaloid production system. Inefficiencies in the performance of each reaction, starting from an economically available substrate, effectively are amplified along the chain of contiguous enzymes, thereby substantially compromising the yield of a final desired alkaloid product.

Thus is unclear whether and how existing methodologies may be used to achieve commercial biosynthesis of plant alkaloid compounds and their derivatives. There exists therefore in the art a need for improved methods for the biosynthesis of alkaloid compounds.

SUMMARY OF THE DISCLOSURE

The following paragraphs are intended to introduce the reader to the more detailed description that follows and not to define or limit the claimed subject matter of the present disclosure.

The present disclosure relates to improved polynucleotide sequences useful in the synthesis of alkaloid compounds, as well as to methods of preparing such improved polynucleotide sequences.

Accordingly, the present disclosure provides, in at least one aspect, at least one embodiment of a method of preparing an improved polynucleotide sequence for the biosynthesis of an alkaloid compound, the method comprising:
  (a) providing a plurality of plant species capable of synthesizing an alkaloid compound;
  (b) preparing a polynucleotide library from a polynucleotide fraction obtained from each of the plant species, each polynucleotide library comprising a pool of polynucleotides;
  (c) determining the nucleic acid sequences of the polynucleotides in each of the pools of polynucleotides;
  (d) identifying a plurality of candidate polynucleotides from the pools of polynucleotides by comparing the nucleic acid sequence of a polynucleotide known to be involved in the synthesis of an alkaloid compound with the nucleic acid sequences of the polynucleotides in the pools, and identifying a plurality of candidate polynucleotides, each of which comprises a nucleic acid sequence substantially identical to the nucleic acid sequence of the polynucleotide known to be involved in the synthesis of alkaloid compounds;
  (e) evaluating synthesis of an alkaloid compound using an expression system that permits the quantitative measurement of the alkaloid compound synthesized using the candidate polynucleotides; and
  (f) selecting from the candidate polynucleotides a polynucleotide providing an improved amount of the alkaloid compound in the expression system.

In a preferred embodiment of the present disclosure, the polynucleotide library is a cDNA polynucleotide library prepared from an alkaloid synthesizing tissue, and accordingly the candidate polynucleotides are cDNA polynucleotides.

In further preferred embodiments, the selected polynucleotide encodes a substantially specific alkaloid biosynthetic enzyme.

In a further aspect, the present disclosure relates to methods for the production of an alkaloid compound in a cell. Accordingly, the present disclosure further includes a method of producing an alkaloid compound in a host cell, the method comprising:

(a) providing a first chimeric nucleic acid sequence comprising as operably linked components:
 (i) a first polynucleotide obtainable from a first plant capable of producing an alkaloid compound encoding a first enzyme capable of catalyzing a chemical reaction that converts a first alkaloid compound into a second alkaloid compound; and
 (ii) one or more polynucleotides capable of controlling expression in a cell;

(b) providing a second chimeric nucleic acid sequence comprising as operably linked components:
 (i) a second polynucleotide obtainable from a second plant capable of producing an alkaloid compound encoding a second enzyme capable of catalyzing a chemical reaction that converts the second alkaloid compound into a third alkaloid compound; and
 (ii) one or more polynucleotides capable of controlling expression in a cell;

(c) introducing the first and second chimeric nucleic acid sequence into the host cell; and (d) growing the cell to produce the first and second enzyme and the second and third alkaloid compound; and wherein the first and second polynucleotide are non-homologous and wherein the third alkaloid compound is produced in the cell at a level in excess of the level of alkaloid produced when a homologous first and second polynucleotide are used.

The present disclosure further provides in at least one aspect at least one embodiment of making an alkaloid compound, comprising:

(a) providing a first alkaloid compound;
(b) contacting the alkaloid compound with an O-methyltransferase and/or an N-methyltransferase under reaction conditions that permit methylation of the alkaloid compound to form a second alkaloid compound;

wherein the first alkaloid compound has the chemical formula:

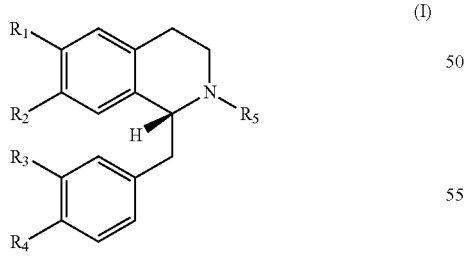

(I)

wherein $R_1$, $R_2$, $R_3$ and $R_4$ each independently or simultaneously represent a hydroxyl group or a methoxy group, with the proviso that $R_1$, $R_2$, $R_3$ and $R_4$ do not each simultaneously represent a methoxy group, and wherein $R_5$ represents a hydrogen atom or a methyl group;

and wherein the second alkaloid compound has the chemical formula:

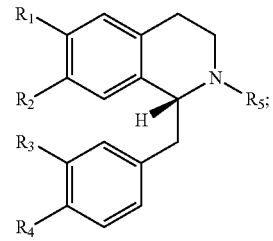

(II)

and wherein $R_1$, $R_2$, $R_3$ and $R_4$ each independently or simultaneously represent a hydroxyl group or a methoxy group, with the proviso that at least one of $R_1$, $R_2$, $R_3$ and $R_4$ represents a methoxy group, and wherein $R_5$ represents a hydrogen atom or a methyl group.

In preferred embodiments the O-methyltransferase is a methyltransferase obtainable or obtained from *Glaucum flavium*.

The present disclosure further includes, in at least one aspect, at least one embodiment of a method of making an alkaloid compound, comprising:

(a) providing a first alkaloid compound;
(b) contacting the alkaloid compound with an O-methyltransferase under reaction conditions that permit methylation of the alkaloid compound to form a second alkaloid compound;

wherein the first alkaloid compound has the chemical formula:

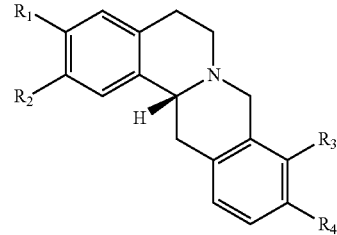

(III)

wherein $R_1$, $R_2$, $R_3$ and $R_4$ each independently or simultaneously represent a hydroxyl group or a methoxy group, with the proviso that $R_1$, $R_2$, $R_3$ and $R_4$ do not each simultaneously represent a methoxy group;

and wherein the second alkaloid compound has the chemical formula:

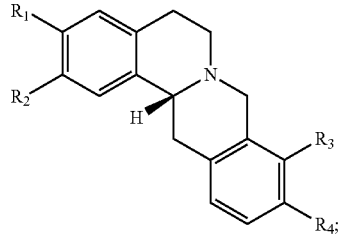

(IV)

and wherein $R_1$, $R_2$, $R_3$ and $R_4$ each independently or simultaneously represent a hydroxyl group or a methoxy group, with the proviso that at least one of $R_1$, $R_2$, $R_3$ and $R_4$ represents a methoxy group.

Other features and advantages of the present disclosure will become apparent from the following detailed description. It should be understood, however, that the detailed description, while indicating preferred implementations of the disclosure, are given by way of illustration only, since various changes and modifications within the spirit and scope of the disclosure will become apparent to those of skill in the art from the detailed description

BRIEF DESCRIPTION OF THE DRAWINGS AND TABLES

The disclosure is in the hereinafter provided paragraphs described in relation to its Figures and Tables. The Figures and Tables provided herein are provided for illustration purposes and are not intended to limit the present disclosure.

FIG. 1 depicts N-methylation reactions catalyzed by CNMT, PavNMT and TNMT, and the proposed NMT-catalyzed conversion of (S)-corytuberine to (+)-magnoflorine. CNMT catalyzes the formation of (S)—N-methylcoclaurine from the 1-benzylisoquinoline (S)-coclaurine, PavNMT converts (S)-pavine to (S)—N-methylpavine, and TNMT N-methylates several different protoberberine alkaloids such as (S)-stylopine.

Figure 2:
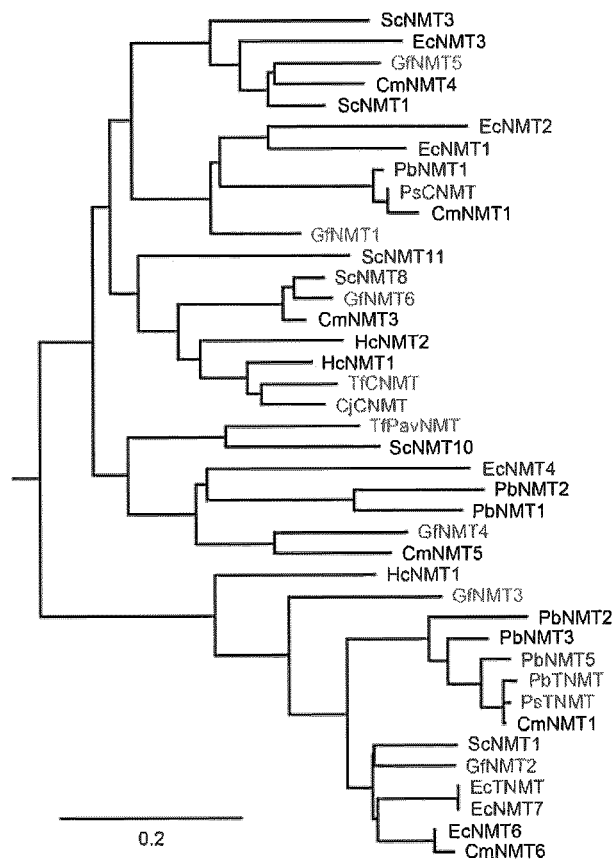

FIG. 2 depicts a phylogenetic analysis of N-methyltransferase (NMT) candidates in the 454 and Illumina GA databases of 20 BIA-producing plant species listed in TABLES 2-4. A total of 33 full-length cDNA sequences NMTs were found. Several functionally characterized NMTs are indicated in red. Sequences from *Glaucium flavum* are shown in green. Abbreviations and accession numbers: PsCNMT, *Papaver somniferum* coclaurine N-methyltransferase (AAP45316); TfCNMT, *Thalictrum flavum* coclaurine N-methyltransferase (AY610508); CjCNMT *Coptis japonica* coclaurine N-methyltransferase (BAB71802); TfPavNMT, *Thalictrum flavum* pavine N-methyltransferase (EU883010); EcTNMT, *Eschscholzia californica* tetrahydroprotoberberine N-methyltransferase (EU882977); PbTNMT, *Papaver bracteatum* tetrahydroprotoberberine N-methyltransferase (EU882994); PsTNMT, *Papaver somniferum* tetrahydroprotoberberine N-methyltransferase (DQ028579); Cm, *Chelidonium majus*; Gf, *Glaucium flavum*; Hc, *Hydrastis canadensis*; Sc, *Sanguinaria canadensis*.

Figure 3:
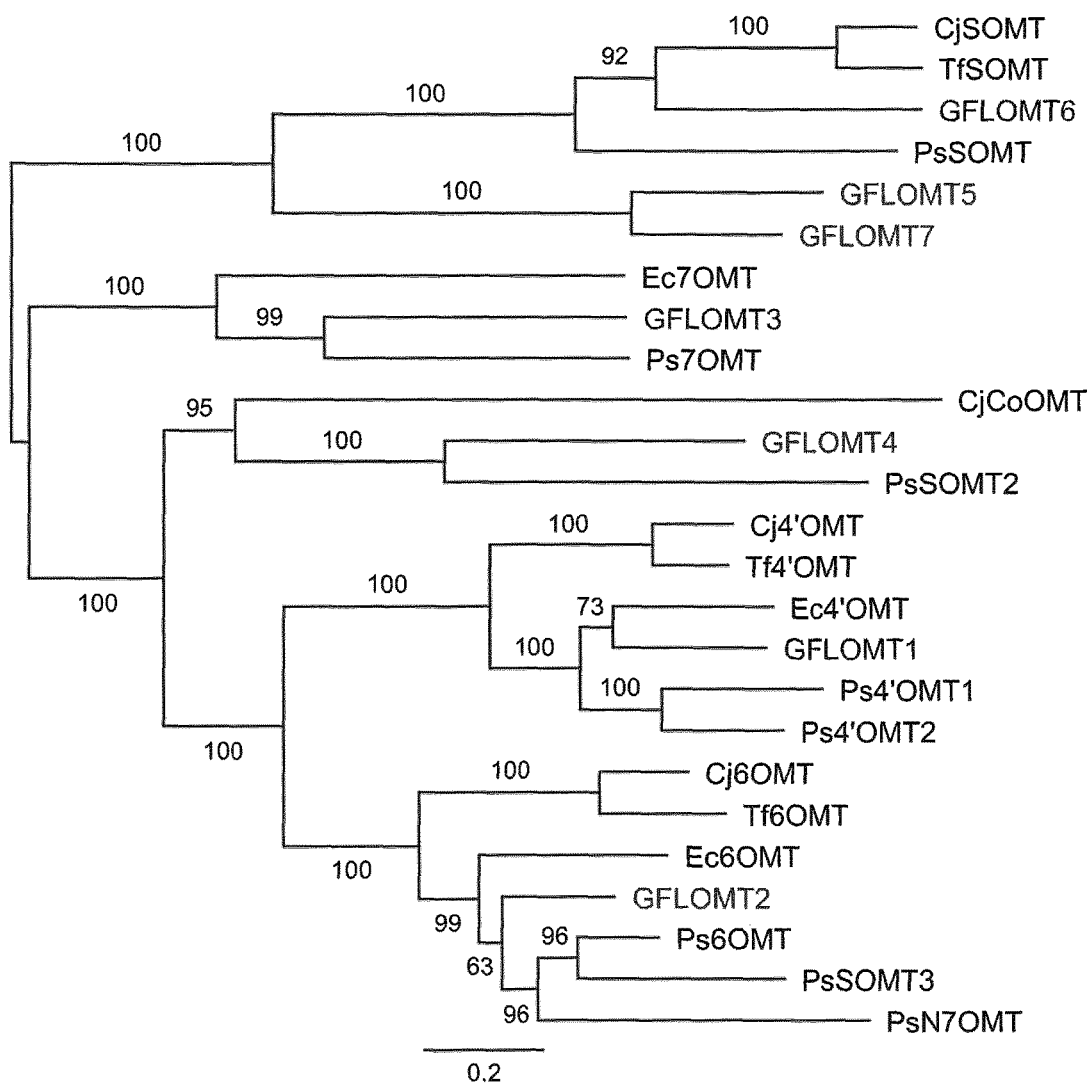

FIG. 3 depicts a phylogenetic analysis of O-methyltransferase (OMT) candidate sequences. Candidates in the 454 and Illumina GA databases of 20 BIA-producing plant species listed in TABLES 2-4. A total of 25 cDNA OMTs were identified. Sequences of *Glaucium flavum* are shown in red. Abbreviations: GFLOMT1-GFLOMT7: *Glaucum flavium* OMT1 to OMT7; PsSOMT-PsSOMT3: *Papaver somniferum* OMT to OMT 3; Ps4'OMT1-PS4'OMT2: *Papaver somniferum* 4'OMT1 to 4'OMT2; Ps6OMT-Ps7OMT: *Papaver somniferum* 6OMT to 7OMT; PsN7OMT: *Papaver somniferum* N7OMT; Ec6OMT-Ec7OMT: *Eschscholzia californica* 6OMT to 7OMT; Ec4'OMT: *Eschscholzia californica* Ec4'OMT; CjSOMT: *Coptis japonica* OMT; JcCoOMT: *Coptis japonica* CoOMT; Cj 4'OMT: *Coptis japonica* 4'OMT; Cj6OMT: *Coptis japonica* 6OMT; Tf4'OMT: *Thalictrum flavum* 4'OMT; and Tf6OMT: *Thalictrum flavum* 6OMT.

Figure 4:
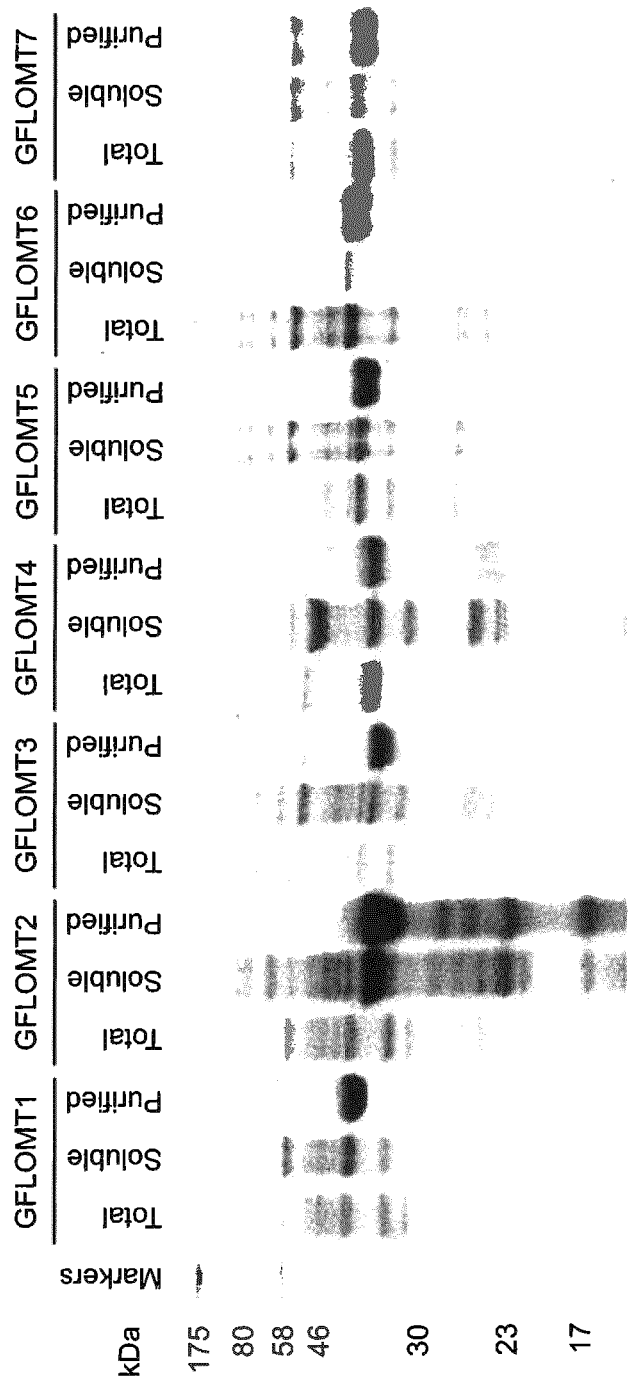

FIG. 4 shows a coomassie blue stained gel following gel electrophoresis of *E. coli* protein extracts expressing various *Glaucium flavum* O-methyl transferases (GFLOMT1-GFLOMT7). Shown for each GFLOMT1 to GFLOMT7 are total extract, soluble protein and purified OMT.

Figure 5:
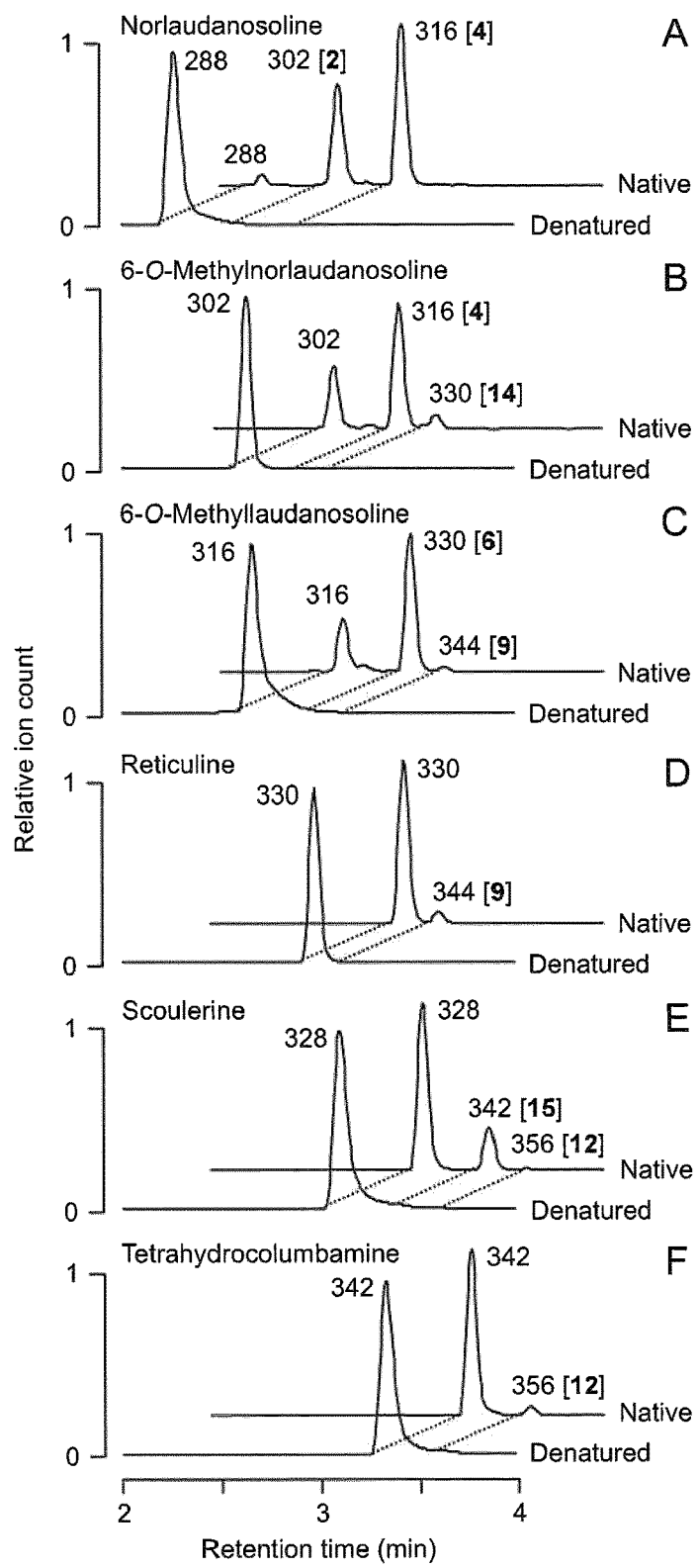

FIG. 5 depicts the results obtained from positive-mode electrospray ionization (ESI[+]) LC-MS/MS for reaction product characterization, including collision-induced dissociation (CID) fragmentation analysis upon incubation of GFLOMT1 with Norlaudanosoline (FIG. 5A), 6-O-Methyl-norlaudanosoline (FIG. 5B), 6-O-Methyllaudanosoline (FIG. 5C), Reticuline (FIG. 5D), Scoulerine (FIG. 5E) and Tetrahydrocolumbamine (FIG. 5F)

Figure 6:
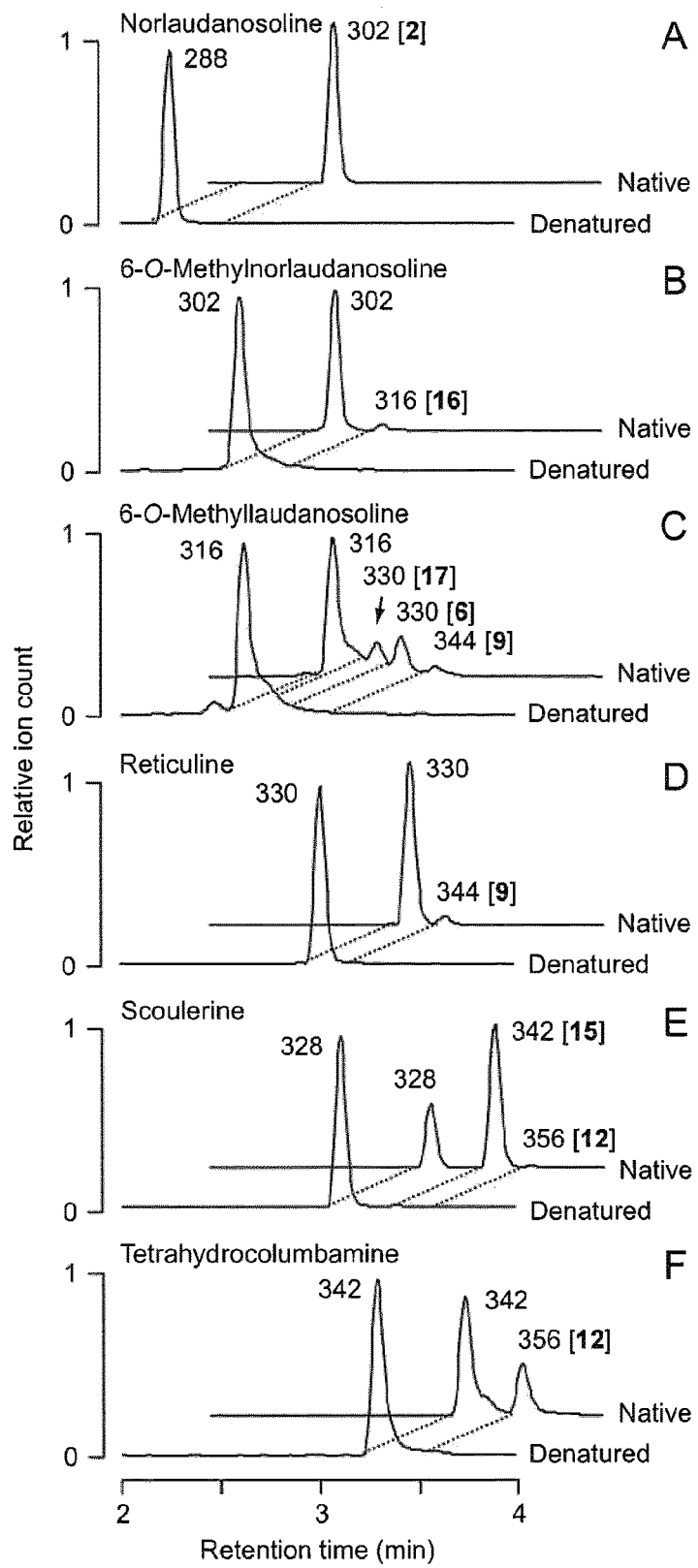

FIG. 6 depicts the results obtained from positive-mode electrospray ionization (ESI[+]) LC-MS/MS for reaction product characterization, including collision-induced dissociation (CID) fragmentation analysis using GFLOMT2 upon incubation of GFLOMT2 with Norlaudanosoline (FIG. 6A), 6-O-Methylnorlaudanosoline (FIG. 6B), 6-O-Methyllaudanosoline (FIG. 6C), Reticuline (FIG. 6D), Scoulerine (FIG. 6E) and Tetrahydrocolumbamine (FIG. 6F)

Figure 7:
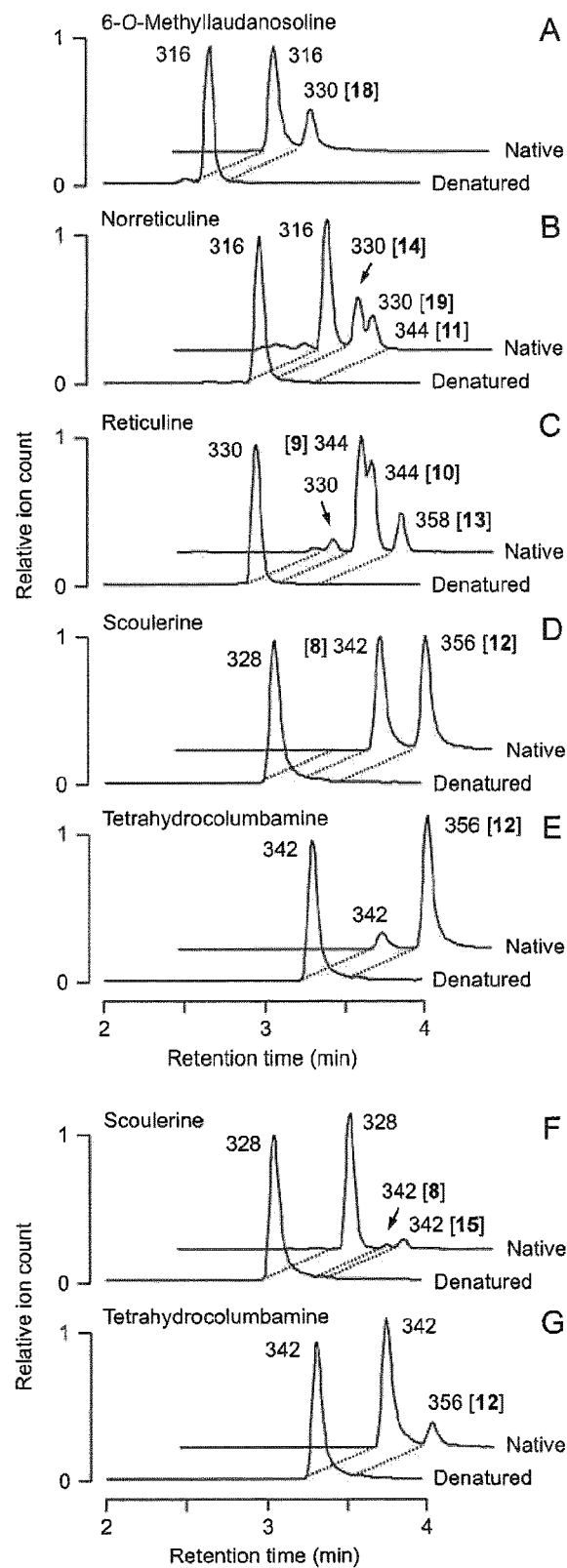

FIG. 7 depicts the results obtained from positive-mode electrospray ionization (ESI[+]) LC-MS/MS for reaction product characterization, including collision-induced dissociation (CID) fragmentation analysis upon incubation of GFLOMT6 with, 6-O-Methyllaudanosoline (FIG. 7A), Norreticuline (FIG. 7B) Reticuline (FIG. 7C), Scoulerine (FIG. 7D) and Tetrahydrocolumbamine (FIG. 7E) and incubation of GFLOMT7 with Scoulerine (FIG. 7F) and Tetrahydrocolumbamine (FIG. 7G).

Figure 8:
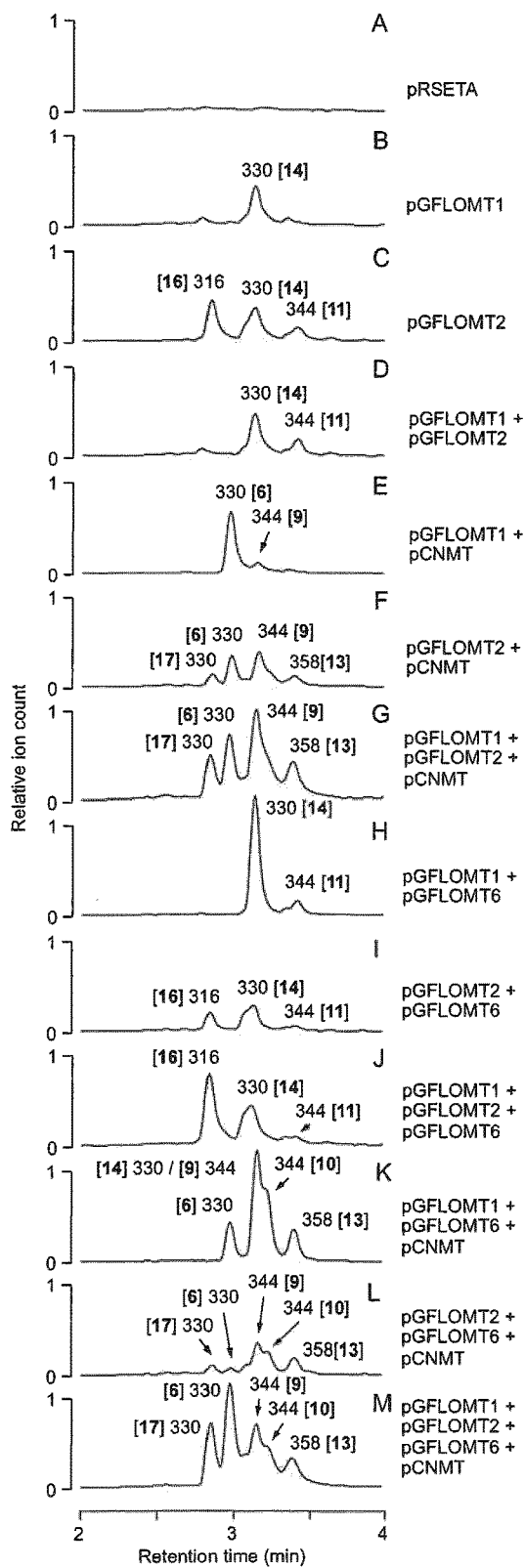

FIG. 8 depicts the results obtained from positive-mode electrospray ionization (ESI[+]) LC-MS/MS for reaction product characterization, including collision-induced dissociation (CID) fragmentation analysis using (R,S)-Norlaudanosoline fed to mixed cultures of *E. coli* harboring different combinations and the various permutations of pGFLOMT1, pGFLOMT2, pGFLOMT6, and pCNMT indicated in FIG. 8A-FIG. 8M).

Figure 9:
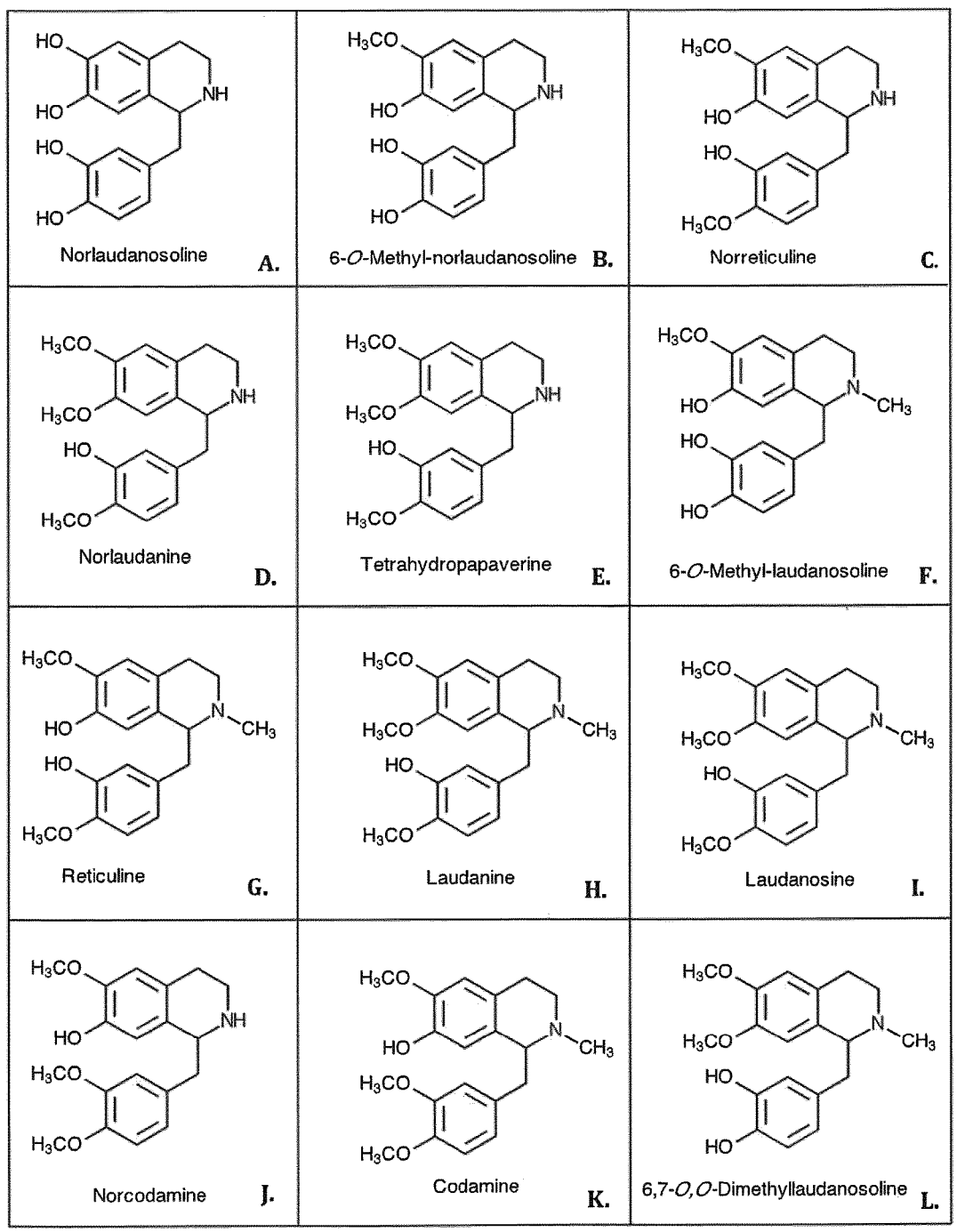

FIG. 9 depicts the chemical structures for certain alkaloid compounds including Norlaudanosoline (FIG. 9A); 6-O-Methyl-norlaudansoline (FIG. 9B); Norreticuline (FIG. 9C); Norlaudanine (FIG. 9D); Tetrahydropapaverine (FIG. 9E); 6-O-Methyl-laudanosoline (FIG. 9F); Reticuline (FIG. 9G); Laudanine (FIG. 9H); Laudanosine (FIG. 9I); Norcodamine (FIG. 9J); Codamine (FIG. 9K) and 6,7-O—O-Dimethyllaudanosoline (FIG. 9L).

Figure 10:
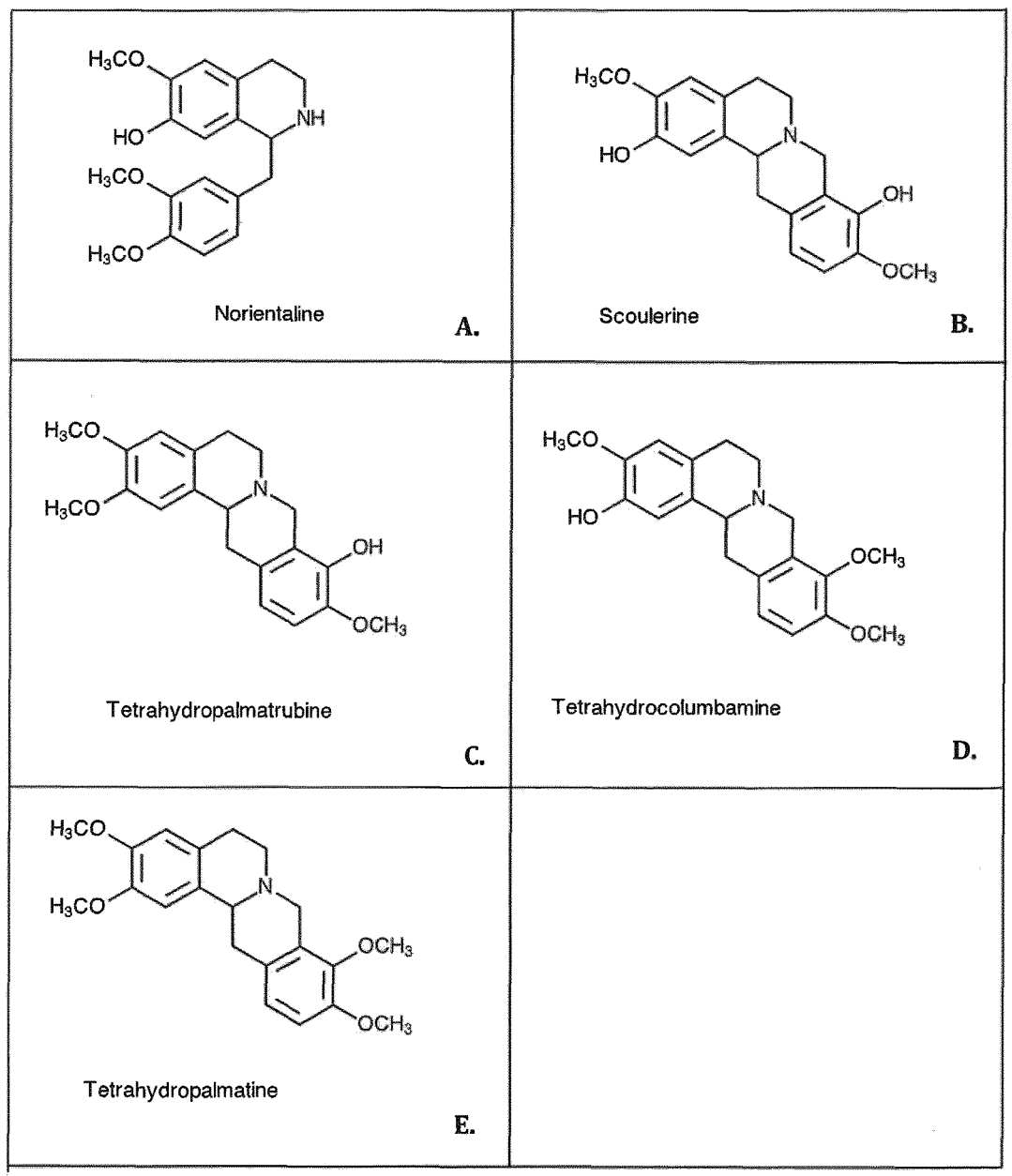

FIG. 10 depicts the chemical structures of certain alkaloid compounds, including Norientaline (FIG. 10A), Scoulerine (FIG. 10B), Tetrahydropalmatrubine (FIG. 10C), Tetrahydrocolumbamine (FIG. 10D) and Tetrahydropalmatine (FIG. 10E).

TABLE 1 tabulates exemplary enzymes, including references to amino acid and polynucleotide SEQ. ID NO's provided herein, and exemplary products and substrates for such enzymes.

TABLE 2 tabulates the denoted information relating to the GS-FLX Titanium (Roche) sequencing of 20 alkaloid producing plant species provided in the column labeled "Plant".

TABLE 3 tabulates the denoted information relating to the GA/HiSeq (illumina) sequencing of 20 alkaloid producing plant species provided in the column labeled "Plant".

TABLE 4 tabulates comparative information relating to the GS-FLX Titanium sequencing and GA/HiSeq sequencing of 20 alkaloid producing plant species provided in the column labeled "Plant".

TABLE 5 tabulates the substrate specificity for the denoted substrates of seven *Glaucium flavum* O-methyl transferases (GFLOMT1-GFLOMT7)

TABLE 6 tabulates chromatographic and mass spectral data for authentic benzylisoquinoline alkaloid standards.

TABLE 7 tabulates chromatographic and mass spectral data for the reaction products of recombinant GFLOMTs assayed with various substrates. ESI[+]-CID fragments in red and green are diagnostic for the number of O-methyl and/or N-methyl groups on the isoquinoline and benzyl moieties, respectively, of each reaction product. Compound names in blue were inferred from the ESI[+]-CID data. Numbers in square brackets identify compounds on chromatograms.

DETAILED DESCRIPTION OF THE DISCLOSURE

As hereinbefore mentioned, the current disclosure relates to polynucleotides useful in the synthesis of alkaloid compounds, such as benzyl isoquinoline alkaloids. The herein provided methods represent an efficient means for identifying novel improved polynucleotides useful in the synthesis of alkaloid compounds. These methods permit rapid identification and testing of candidate polynucleotide sequences for their utility in alkaloid synthesis. The methods of the present disclosure result in a significant improvement in the efficiency of individual chemical reactions in an alkaloid biosynthesis pathway. The techniques in particular improve substrate specificity of one or more enzymes in a biosynthetic pathway, thereby improving the efficiency with which a desired alkaloid product can be synthesized. The methods of the present disclosure do not rely on the prediction of enzyme function based on sequence information and/or structural enzyme models. The present disclosure also relates to methods of making alkaloid compounds. The methods for synthesis of alkaloids provided herein do not rely on chemical synthesis and may be conducted on a commercial scale.

Accordingly, the present disclosure provides in at least one aspect at least one embodiment a method of preparing an improved polynucleotide sequence for the biosynthesis of an alkaloid compound, the method comprising:
  (a) providing a plurality of plant species capable of synthesizing an alkaloid compound;
  (b) preparing a polynucleotide library from a polynucleotide fraction obtained from each of the plant species, each polynucleotide library comprising a pool of polynucleotides;
  (c) determining the nucleic acid sequences of the polynucleotides in each of the pools of polynucleotides;
  (d) identifying a plurality of candidate polynucleotides from the pools of polynucleotides by comparing the nucleic acid sequence of a polynucleotide known to be involved in the synthesis of an alkaloid compound with the nucleic acid sequences of the polynucleotides in the pools, and identifying a plurality of candidate polynucleotides, each of which comprises a nucleic acid sequence substantially identical to the nucleic acid sequence of the polynucleotide known to be involved in the synthesis of alkaloid compounds;
  (e) evaluating synthesis of an alkaloid compound using an expression system that permits the quantitative measurement of the alkaloid compound synthesized using the candidate polynucleotides; and
  (f) selecting from the candidate polynucleotides a polynucleotide providing an improved amount of the alkaloid compound in the expression system.

Definitions

The terms "alkaloid" or "alkaloid compound", as may be used interchangeably herein, refers to naturally occurring chemical compounds containing basic nitrogen atoms, and derivatives and analogues thereof, including, but not limited to compounds belonging to the pyridine group (for example, piperine and nicotine); the pyrrolidine group (for example, hygrine, cuscohygrine, nicotine); the tropane group (for example, atropine, and cocaine); the quinoline group (for example, quinine, quinidine, dihydroquinine, dihydroquinidine, strychnine); the isoquinoline group (for example, opium alkaloids (papaverine, narcotine, narceine); the phenanthrene alkaloid group (for example, the opium alkaloids (morphine, codeine, thebaine)); the phenethyl amine group (for example, mescaline, ephedrine, dopamine); the indole group which includes tryptamines (for example, serotonin), ergolines (for example, ergine, ergotamine, lysergic acid, LSD), beta-carbolines (for example, harmine, harmaline, tetrahydroharmine), yohimbans (for example, reserpine, yohimbine), vinca alkaloids (for example, vinblastine, vincristine), mitragyna speciosa alkaloids (for example, mitragynine, 7-hydroxymitragynine), tabernanthe iboga alkaloids (for example, ibogaine, voacangine, coronaridine, 18-methoxycoronaridine), strychnos nuxvomica alkaloids (for example, strychnine, brucine); the purine group (for example, xanthines: caffeine, theobromine, theophylline); the terpenoid group which include aconite alkaloids (aconitine), steroid alkaloids (containing a steroid skeleton in a nitrogen containing structure, for example, solanum (for example, potato and tomato) alkaloids (solanidine, solanine, chaconine), veratrum alkaloids (veratramine, cyclopamine, cycloposine, jervine, muldamine), newt alkaloids (samandarin), and others (for example, conessine); quaternary ammonium compound group (for example, muscarine, choline, neurine); and miscellaneous alkaloids such as, for example, capsaicin, cynarin, phytolaccine, and phytolacco toxin.

The term Norlaudanosoline as used herein refers to a chemical compound having the chemical structure depicted in FIG. 9A.

The term 6-O-Methyl-norlaudansoline as used herein refers to a chemical compound having the chemical structure depicted in FIG. 9B.

The term Norreticuline as used herein refers to a chemical compound having the chemical structure depicted in FIG. 9C.

The term Norlaudanine as used herein refers to a chemical compound having the chemical structure depicted in FIG. 9D.

The term Tetrahydropapaverine as used herein refers to a chemical compound having the chemical structure depicted in FIG. 9E.

The term 6-O-Methyl-laudanosoline as used herein refers to a chemical compound having the chemical structure depicted in FIG. 9F.

The term Reticuline as used herein refers to a chemical compound having the chemical structure depicted in FIG. 9G.

The term Laudanine as used herein refers to a chemical compound having the chemical structure depicted in FIG. 9H.

The term Laudanosine as used herein refers to a chemical compound having the chemical structure depicted in FIG. 9I.

The term Norcodamine as used herein refers to a chemical compound having the chemical structure depicted in FIG. 9J.

The term Codamine as used herein refers to a chemical compound having the chemical structure depicted in FIG. 9K.

The term 6,7-O—O-Dimethyllaudanosoline as used herein refers to a chemical compound having the chemical structure depicted in FIG. 9L.

The term Norientaline as used herein refers to a chemical compound having the chemical structure depicted in FIG. 10A.

The term Scoulerine as used herein refers to a chemical compound having the chemical structure depicted in FIG. 10B.

The term Tetrahydropalmatrubine as used herein refers to a chemical compound having the chemical structure depicted in FIG. 10C.

The term Tetrahydrocolumbamine as used herein refers to a chemical compound having the chemical structure depicted in FIG. 10D.

The term Tetrahydropalmatine as used herein refers to a chemical compound having the chemical structure depicted in FIG. 10E.

The term "cDNA" as used herein refers to all polynucleotides that share the arrangement of sequence elements found in native mature mRNA species, where sequence elements are exons and 5' and 3' non-coding regions. Normally mRNA species have contiguous exons, with the intervening introns, when present, being removed by nuclear RNA splicing, to create a continuous open reading frame encoding the protein.

The term "homologous" as used herein in reference to polynucleotides and polynucleotide sequences is intended to mean obtainable from the same biological species, i.e. a first and second polynucleotide sequence are homologous when they are obtainable from the same biological species, and conversely, a first and second polynucleotide sequence are non-homologous when they are obtainable or obtained from two different biological species.

The term "in vitro" as used herein refers to the performance of a biochemical reaction outside a living cell, including, for example, in a microwell plate, a tube, a flask, a tank, a reactor and the like, for example a reaction to form an alkaloid compound.

The term "in vivo" as used herein refers to the performance of a biochemical reaction within a living cell, including, for example, a microbial cell, or a plant cell, for example to form an alkaloid compound.

The term "polynucleotide" as used herein refers to a sequence of nucleoside or nucleotide monomers consisting of naturally occurring bases, sugars and intersugar (backbone) linkages. The term also includes modified or substituted sequences comprising non-naturally occurring monomers or portions thereof. The nucleic acid sequences of the present disclosure may be deoxyribonucleic acid sequences (DNA) or ribonucleic acid sequences (RNA) and may include naturally occurring bases including adenine, guanine, cytosine, thymidine and uracil. The sequences may also contain modified bases. Examples of such modified bases include aza and deaza adenine, guanine, cytosine, thymidine and uracil, and xanthine and hypoxanthine.

The term "percent sequence identity" refers to the degree of identity between any given query sequence and a subject sequence. A subject sequence typically has a length that is from about 80 percent to about 250 percent of the length of the query sequence, e.g., 82, 85, 87, 89, 90, 93, 95, 97, 99, 100, 105, 110, 115, or 120, 130, 140, 150, 160, 170, 180, 190, 200, 210, 220, 230, 240, or 250 percent of the length of the query sequence. A query nucleic acid or amino acid sequences is aligned to one or more subject nucleic acid or amino acid sequences using the computer program ClustalW (version 1.83, default parameters), which allows alignments of nucleic acid or protein sequences to be carried out across their entire length (global alignment). Chenna et al. (2003) Nucleic Acids Res. 31(13):3497-500. Optimal alignment of sequences for comparison may be conducted by the local homology algorithm of Smith and Waterman (1981) Add. APL. Math. 2:482, by the homology alignment algorithm of Needleman and Wunsch (1970) J. Mol. Biol. 48:443, by the search for similarity method of Pearson and Lipman (1988) Proc. Natl. Acad. Sci. (USA) 85: 2444, by computerized implementations of algorithms such as GAP, BESTFIT, BLAST, PASTA, and TFASTA (Wisconsin Genetics Software Package, Genetics Computer Group (GCG), 575 Science Dr., Madison, Wis.) or by inspection. Typically, the default values of 5.00 for gap weight and 0.30 for gap weight length are used. ClustalW calculates the best match between a query and one or more subject sequences, and aligns them so that identities, similarities and differences can be determined Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For an alignment of multiple nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The output is a sequence alignment that reflects the relationship between sequences. ClustalW can be run, for example, at the Baylor College of Medicine Search Launcher website and at the European Bioinformatics Institute website on the World Wide Web. To determine a percent identity for polypeptide or nucleic acid sequences between a query and a subject sequence, the sequences are aligned using Clustal W and the number of identical matches in the alignment is divided by the query length, and the result is multiplied by 100. The output is the percent identity of the subject sequence with respect to the query sequence. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

The term "substantial sequence identity" between polynucleotide or polypeptide sequences refers to polynucleotide or polypeptide comprising a sequence that has at least 80% sequence identity, preferably at least 85%, more preferably at least 90% and most preferably at least 95%, even more preferably, at least 96%, 97%, 98% or 99% sequence identity, however in each case less than 100%, compared to a reference polynucleotide sequence using the programs.

The terms "O-methyltransferase", or "OMT", which may be used interchangeably herein, refer to any and all enzymes comprising a sequence of amino acid residues which is (i) substantially identical to the amino acid sequences constituting any OMT polypeptide set forth herein, including, for example, SEQ. ID NO: 1592, SEQ. ID NO: 1593; SEQ. ID NO: 1597; and SEQ. ID NO: 1598, or (ii) encoded by a nucleic acid sequence capable of hybridizing under at least moderately stringent conditions to any nucleic acid sequence encoding any OMT polypeptide set forth herein, but for the use of synonymous codons.

The terms "N-methyltransferase", or "NMT", which may be used interchangeably herein, refer to any and all enzymes comprising a sequence of amino acid residues which is (i) substantially identical to the amino acid sequences constituting any NMT polypeptide set forth herein, including, for example, SEQ. ID NO: 1749, or (ii) encoded by a nucleic acid sequence capable of hybridizing under at least moderately stringent conditions to any nucleic acid sequence encoding any NMT polypeptide set forth herein, but for the use of synonymous codons.

General Implementation

In one embodiment of the present disclosure, there is provided a method of preparing an improved polynucleotide sequence for the biosynthesis of an alkaloid compound. In one aspect, the herein provided method involves providing a plurality of plant species capable of synthesizing an alkaloid compounds. Alkaloid compounds that are particularly preferred in accordance herewith are benzylisoquinoline alkaloids, including L-tyrosine, tyramine, dopamine, 4-hydroxyphenylpyruvate, 4-hydroxyphenylacetaldehyde, (S)—Nocroclaurine, (S)-1-hydroxy-N-methylcanadine, narcotinohemiacetal, noscapine, (S)—N-methylcanadine, (S)-coclaurine, (S)-norreticuline, (S)-tetrahydropapaverine, papaverine, oripavine, thebaine, salutardinol, (S)—N-methylcoclaurine, (S)-canadine, berberine, berbamunine, morphinone, codeinone, salturadine, coryturbine, (S)-3-hydroxy-N-methylcoclaurine, (S)-tetrahydrocolumbamine, (S)-tetrahydropalmatine, morphine, codeine, (R)-reticuline, (S)-reticuline, (S)-scoulerine, (S)-cheilanthifoline, sanguinarine, dihydrosanguinarine, protopine, (S)-cis-N-methylstylopine, (S)-stylopine, 1-benzylisoquinoline, protoberberine, papverubine, aporphine, benzo[c]phenanthridine, phtalideisoquinoline, secoisoquinoline, promorphinan, morphinan, pavine, isopavine and bisbenzylisoquinoline. Plant species that may be used in accordance herewith include, without limitation, plant species belonging to the plant families of Eupteleaceae, Lardizabalaceae, Circaeasteraceae, Menispermaceae, Berberidaceae, Ranunculaceae, and Papaveraceae (including those belonging to the subfamilies of Pteridophylloideae, Papaveroideae and Fumarioideae) and further includes plants belonging to the genus *Argemone*, including *Argemone mexicana* (Mexican Prickly Poppy), plants belonging to the genus *Berberis*, including *Berberis thunbergii* (Japanese Barberry), plants belonging to the genus *Chelidonium*, including *Chelidonium majus* (Greater Celandine), plants belonging to the genus *Cissampelos*, including *Cissampelos mucronata* (Abuta), plants belonging to the genus *Cocculus*, including *Cocculus trilobus* (Korean Moonseed), plants belonging to the genus *Corydalis*, including *Corydalis chelanthifolia* (Ferny Fumewort), plants belonging to the genus *Eschscholzia*, including *Eschscholzia californica* (California Poppy), plants belonging to the genus *Glaucium*, including *Glaucium flavum* (Yellowhorn Poppy), plants belonging to the genus *Hydrastis*, including *Hydrastis canadensis* (Goldenseal), plants belonging to the genus *Jeffersonia*, including *Jeffersonia diphylla* (Rheumatism Root), plants belonging to the genus *Mahonia*, including *Mahonia aquifolium* (Oregon Grape), plants belonging to the genus *Menispermum*, including *Menispermum canadense* (Canadian Moonseed), plants belonging to the genus *Nandina*, including *Nandina domestica* (Sacred Bamboo), plants belonging to the genus *Nigella*, including *Nigella sativa* (Black Cumin), plants belonging to the genus *Papaver*, including *Papaver bracteatum* (Persian Poppy) and *Papver somniferum*, plants belonging to the genus *Sanguinaria*, including *Sanguinaria canadensis* (Bloodroot), plants belonging to the genus *Stylophorum*, including *Stylophorum diphyllum* (Celandine Poppy), plants belonging to the genus *Thalictrum*, including *Thalictrum flavum* (Meadow Rue), plants belonging to the genus *Tinospora*, including *Tinospora cordifolia* (Heartleaf Moonseed) and plants belonging to the genus *Xanthoriza*, including *Xanthoriza simplicissima* (Yellowroot).

In a further aspect, the herein provided method involves the preparation of a polynucleotide library from a plant. Methods to prepare such polynucleotide library may be as desired. In general, methods to prepare a polynucleotide library involve isolation of a polynucleotide fraction (e.g. a DNA fraction or an RNA fraction) from plant cells, fractionating the polynucleotide fraction into a pool of polynucleotide fragments (preferably DNA fragments), cloning the polynucleotide fragments within the pool into a vector, e.g. a plasmid or viral vector, and maintaining the cloned fragments into a host, e.g. a microbial host such as a bacterial host or a yeast cell host. The techniques and methodologies for preparing a polynucleotide library are well known to those in the art and further details may be found in Sambrook J. and Green M., Molecular Cloning: A Laboratory Manual, 2012, Cold Spring Harbor Press. In a preferred embodiment hereof the polynucleotide library is a cDNA library prepared from a plant tissue synthesizing alkaloid compounds. Such tissue may be any plant tissue synthesizing alkaloids, including for example, plant stem tissue, bark tissue, leaf tissue, seed tissue, fruit tissue, flower tissue, root tissue, rhizome tissue or callus tissue, obtained, for example, from the hereinbefore mentioned plants. In preferred embodiments, the following tissues used in accordance herewith are: stem of *Argemone mexicana* (Mexican Prickly Poppy), root of *Berberis thunbergii* (Japanese Barberry), stem of *Chelidonium majus* (Greater Celandine), callus of *Cissampelos mucronata* (Abuta), callus of *Cocculus trilobus* (Korean Moonseed), root of *Corydalis chelanthifolia* (Ferny Fumewort), root of *Eschscholzia californica* (California Poppy), root of *Glaucium flavum* (Yellowhorn Poppy), rhizome of *Hydrastis canadensis* (Goldenseal), root of *Jeffersonia diphylla* (Rheumatism Root), bark of *Mahonia aquifolium* (Oregon Grape), rhizome of *Menispermum canadense* (Canadian Moonseed), root of *Nandina domestica* (Sacred Bamboo), root of *Nigella sativa* (Black Cumin), stem of *Papaver bracteatum* (Persian Poppy), rhizome of *Sanguinaria canadensis* (Bloodroot), stem of *Stylophorum diphyllum* (Celandine Poppy), root of *Thalictrum flavum* (Meadow Rue), callus of *Tinospora cordifolia* (Heartleaf Moonseed) or root of *Xanthoriza simplicissima* (Yellowroot).

In a further aspect, the herein provided methods involve the determination of the nucleic acid sequence of the polynucleotide fragments in the pools of polynucleotides. Methods to determine the sequences of polynucleotides may be as desired and are well known to the art in include for example Sanger sequencing, GS-FLX Titanium (Roche) sequencing and GA/HiSeq sequencing (Illumina). The latter two are particularly desirable as they provide for high throughput.

In a further aspect, the herein provided methods involve the identification and isolation of candidate polynucleotides from the pools of sequenced polynucleotides. In accordance herewith, this is achieved by comparing a polynucleotide sequence which is known to be involved in the synthesis of alkaloid compounds, i.e. a query sequence, to the sequences of the polynucleotides in the polynucleotide sequences present in the pools, and determining which sequences among the pools of sequenced polynucleotide sequences are substantially identical to the query sequence. The approach to determining substantial identity may vary, but generally involves determining the percentage identity between the query polynucleotide sequence and the polynucleotide sequences in the pools using in general the methodologies hereinbefore described (see: terms and definitions) and identifying such of the sequences that are substantially identical to the sequence of the query polynucleotide. In an alternate approach, substantial identity may also be established by deriving the polypeptide sequence from the polynucleotide sequence (using the known rules for codon use) and comparing a query polypeptide sequence with the sequences in the pool. In accordance herewith, the polynucleotide sequences in the pools that show substantial sequence identity are candidate polynucleotide sequences, which are subsequently isolated from the pools of polynucleotide sequences. In some cases, part coding sequences may be identified and it may be necessary to identify overlapping polynucleotides in order to identify the full-length polynucleotide sequence. Polynucleotide sequences that may be used as query sequences include any polynucleotide sequences known to be involved in the synthesis of any alkaloid. Examples of enzymes encoding such polynucleotide sequences are provided in TABLE 1 hereto. In accordance herewith, in particularly preferred embodiments, the polynucleotide sequences used in accordance herewith include polynucleotide sequences encoding N-methyltransferases (see: Examples 2 and 3), or O-methyltransferases (see: Examples 4, 5, 6 and 7)

In a further aspect, the present disclosure involves evaluating the production of an alkaloid compound using a system that permits the quantitative measurement of the alkaloid compound synthesized using the candidate polynucleotides. In general, the identified candidate polynucleotide sequences may be cloned into an expression vector and introduced into a host cell, which may be any microbial cell, e.g. a bacterial cell or a yeast cell, plant cell or animal cell. Upon such introduction the production of the alkaloid may be evaluated either in vitro or in vivo. In vitro evaluation may be performed by isolating the enzyme in more or less pure form from the host e.g. by evaluating a cellular fraction (e.g. in the case of yeast, a microsome fraction) obtainable from the host cell comprising the enzyme, incubating the enzyme fraction with its alkaloid substrate and assaying for the alkaloid product. In vivo evaluation may be performed by providing to the host cell a substrate or potential substrate alkaloid to the enzyme encoded by the candidate polynucleotide and evaluating the in vivo production of the product alkaloid. The enzyme conversion rate and/or the substrate specificity for a substrate or potential substrate may be determined qualitatively or quantitatively using enzyme assays. Quantitative determination includes, for example, determining the percentage of substrate converted, or determining key catalytic properties of an enzyme such as the $k_{cat}$ and/or $K_m$ of an enzyme. Methodologies to evaluate the production of an alkaloid compound in a quantitative fashion in accordance herewith will be generally known to those of skill in the art, and include for example liquid chromatography-mass spectrometry (LC/MS) or gas chromatography-mass spectrometry (GC/MS). The production of the alkaloid by different candidate polynucleotides and/or the query polynucleotide may be compared.

In one aspect, in accordance herewith, from the candidate polynucleotides a polynucleotide providing an improved amount of the alkaloid compound in the expression system is selected. In preferred embodiments, the selected polynucleotide is a polynucleotide conveying higher levels of production of the target alkaloid compound than those provided by the query polynucleotide and/or by those observed using the query polynucleotide.

In further embodiments, a polynucleotide encoding an enzyme having narrow substrate specificity is selected. The term "narrow substrate specificity" as used herein refers to an enzyme capable of substantially converting no more than 3, or no more than 2 different alkaloid substrates. The term "substantially converting" as used herein refers to an enzyme capable of converting 90% or more, or 95% or more of that substrate to a single product.

In further embodiments, a polynucleotide encoding a substantially specific alkaloid biosynthetic enzyme is selected. The term "substantially specific alkaloid biosynthetic enzyme" as used herein refers to an enzyme which when presented with an alkaloid substrate under assay conditions is capable of converting 90% or more, or 95% or more of that substrate to an alkaloid product, and when presented with other alkaloid substrates under the same assay conditions is capable of converting no more than 20%, 15%, 10% or 5% of such other alkaloid substrates. Thus, for example, an O-methyltransferase capable of converting 99% of a first benzylisoquinoline when presented therewith, and 10%, 5% and 0%, of a second, third and fourth benzylisoquinoline, respectively, when presented with these compounds, is a substantially specific alkaloid biosynthetic enzyme. Conversely, an O-methyltransferase capable of converting 99% of a first benzylisoquinoline when presented therewith, and 75%, 5% and 0%, of a second, third and fourth benzylisoquinoline, respectively, when presented with these compounds is not a substantially specific alkaloid biosynthetic enzyme.

In additional embodiments, the methods herein provided are conducted in an iterative fashion for the purpose of identifying two or more improved polynucleotide sequences encoding enzymes capable of converting two or more alkaloid compounds in an alkaloid synthesis pathway, for example, 3, 4, 5, 6, 7, 8, 9, 10 or more polynucleotides, each encoding a different enzyme in the same alkaloid biosynthesis pathway. In further embodiments, at least 2, 3, 4, 5, 6, 7, 8, 9, or 10 polynucleotides are selected, each polynucleotide encoding an enzyme that has narrow substrate specificity. In further embodiments, at least 2, 3, 4, 5, 6, 7, 8, 9, or 10 polynucleotides are selected, each polynucleotide encoding a substantially specific alkaloid biosynthetic enzyme. Thus a plurality of improved polynucleotides may be identified and each of these improved polynucleotides may be evaluated in conjunction with one or more other improved polynucleotides. In this manner, the alkaloid synthesis pathway may be improved, and improved levels of an alkaloid compound may be obtained. Levels of alkaloid compound production that may be obtained using the improved polynucleotides of the present disclosure in combination with a recombinant host cell system are typically at least 1.5× in excess of the level of the levels of the alkaloid compound produced in a natural system, and in some embodiments at least 2×, 5×, or at least 10× in excess of the levels of the alkaloid compound produced in a natural system.

The present disclosure further includes novel polynucleotides capable of producing an enzyme involved in the biosynthesis of alkaloid compounds. These polynucleotides include the polynucleotide sequences set forth in SEQ. ID NO: 1-SEQ. ID NO: 870.

In accordance with a further aspect of the present disclosure, included herein are methods for the production of alkaloid compounds in a host cell. Accordingly, the present disclosure further includes a method of producing an alkaloid compound in a host cell, the method comprising:

(a) providing a first chimeric nucleic acid sequence comprising as operably linked components:
   (i) a first polynucleotide obtainable from a first plant capable of producing an alkaloid compound encoding a first enzyme capable of catalyzing a chemical reaction that converts a first alkaloid compound into a second alkaloid compound; and
   (ii) one or more polynucleotides capable of controlling expression in a cell;
(b) providing a second chimeric nucleic acid sequence comprising as operably linked components:
   (i) a second polynucleotide obtainable from a second plant capable of producing an alkaloid compound encoding a second enzyme capable of catalyzing a chemical reaction that converts the second alkaloid compound into a third alkaloid compound; and
   (ii) one or more polynucleotides capable of controlling expression in a cell;
(c) introducing the first and second chimeric nucleic acid sequence into the host cell; and
(d) growing the cell to produce the first and second enzyme and the second and third alkaloid compound; and wherein the first and second polynucleotide are non-homologous and wherein the third alkaloid compound is produced in the cell at a level that is in excess of the level of alkaloid compound produced when a homologous first and second polynucleotide are used.

In preferred embodiments hereof, the alkaloid levels produced using the non-homologous polynucleotides are at least 1.5× in excess of the levels produced using homologous polynucleotides, in more preferred embodiments at least 2×, at least 5× or at least 10× in excess. In further preferred embodiments, the first and second polynucleotide are a polynucleotide encoding any one of the polypeptides set forth in SEQ. ID NO: 871 to SEQ. ID NO: 1749.

In further preferred embodiments hereof, the first and second polynucleotide sequences have been obtained by comparing the production of an alkaloid compound in a cell using a plurality of polynucleotides encoding an enzyme capable of catalyzing a chemical reaction converting a first alkaloid compound into a second alkaloid embodiment, and selecting the polynucleotide providing the highest levels of the second alkaloid compound. In preferred embodiments, such selection is performed by:
   (a) providing a plurality of plant species capable of synthesizing an alkaloid compound;
   (b) preparing a polynucleotide library from each of the plant species, each polynucleotide library comprising a pool of polynucleotides;
   (c) determining the nucleic acid sequences of the polynucleotides in each of the pools of polynucleotides;
   (d) isolating a plurality of candidate polynucleotides from the pools of polynucleotides by comparing the nucleic acid sequence of a polynucleotide known to be involved in the synthesis of an alkaloid compound with the nucleic acid sequences of the polynucleotides in the pools, and identifying a plurality of candidate polynucleotides, each of which comprises a nucleic acid sequence substantially identical to the nucleic acid sequence of the polynucleotide known to be involved in the synthesis of alkaloid compounds;
   (e) evaluating synthesis of an alkaloid compound using an expression system that permits the quantitative measurement of the alkaloid compound synthesized using the candidate polynucleotides; and
   (f) selecting from the candidate polynucleotides a polynucleotide providing an improved amount of the alkaloid compound in the expression system.

Polynucleotides capable of controlling expression in host cells that may be used herein include any transcriptional promoter capable of controlling expression of polypeptides in host cells. Generally, promoters obtained from bacterial cells are used when a bacterial host is selected in accordance herewith, while a fungal promoter will be used when a fungal host is selected, a plant promoter will be used when a plant cell is selected, and so on. Further polynucleotide elements capable elements of controlling expression in a host cell include transcriptional terminators, enhancers and the like, all of which may be included in the chimeric polynucleotides of the present disclosure.

In accordance with the present disclosure, the chimeric polynucleotides can be integrated into a recombinant expression vector, which ensures good expression in a host cell. Accordingly, the present disclosure includes a recombinant expression vector comprising in the 5' to 3' direction of transcription as operably linked components:
   (i) a first polynucleotide capable of controlling expression in a host cell;
   (ii) a first polynucleotide obtainable from a first plant capable of producing an alkaloid compound encoding a first enzyme capable of catalyzing a chemical reaction that converts a first alkaloid compound into a second alkaloid compound;
   (iii) a second polynucleotide capable of controlling expression in a host cell; and
   (iv) a second polynucleotide obtainable from a second plant capable of producing an alkaloid compound encoding a second enzyme capable of catalyzing a chemical reaction that converts the second alkaloid compound into a third alkaloid compound.

wherein the expression vector is suitable for expression in a host cell. The term "suitable for expression in a host cell" means that the recombinant expression vector comprises the chimeric polynucleotide of the present disclosure linked to genetic elements required to achieve expression in a host cell. Genetic elements that may be included in the expression vector in this regard include a transcriptional termination region, one or more polynucleotides encoding marker genes, one or more origins of replication and the like. In preferred embodiments, the expression vector further comprises genetic elements required for the integration of the vector or a portion thereof in the host cell's genome, for example if a plant host cell is used the T-DNA left and right border sequences which facilitate the integration into the plant's nuclear genome.

Pursuant to the present disclosure, the expression vector may further contain a marker gene. Marker genes that may be used in accordance with the present disclosure include all genes that allow the distinction of transformed cells from non-transformed cells, including all selectable and screenable marker genes. A marker gene may be a resistance marker such as an antibiotic resistance marker against, for example, kanamycin or ampicillin. Screenable markers that may be employed to identify transformants through visual inspection include β-glucuronidase (GUS) (U.S. Pat. Nos. 5,268,463 and 5,599,670) and green fluorescent protein (GFP) (Niedz et al., 1995, Plant Cell Rep., 14: 403).

One host cell that particularly conveniently may be used is *Escherichia coli*. The preparation of the *E. coli* vectors may be accomplished using commonly known techniques such as restriction digestion, ligation, gelectrophoresis, DNA sequencing, the Polymerase Chain Reaction (PCR) and other methodologies. A wide variety of cloning vectors is available to perform the necessary steps required to prepare a recombinant expression vector. Among the vectors with a replication system functional in *E. coli*, are vectors such as pBR322, the pUC series of vectors, the M13 mp series of vectors, pBluescript etc. Typically, these cloning vectors contain a marker allowing selection of transformed cells. Nucleic acid sequences may be introduced in these vectors, and the vectors may be introduced in *E. coli* by preparing competent cells, electroporation or using other well known methodologies to a person of skill in the art. *E. coli* may be grown in an appropriate medium, such as Luria-Broth medium and harvested. Recombinant expression vectors may readily be recovered from cells upon harvesting and lysing of the cells. Further, general guidance with respect to the preparation of recombinant vectors and growth of recombinant organisms may be found in, for example: Sambrook J. and Green M., Molecular Cloning: A Laboratory Manual, 2012, Cold Spring Harbor Press.

Methods of Using O-Methyltransferases

As hereinbefore mentioned, in certain embodiments, O-methyltransferases are identified. Such O-methyltransferases include the following O-methyltransferases from *Glaucium flavum*, and further include GFLOMT1 (SEQ. ID NO: 1592), GFLOMT2 (SEQ. ID NO: 1593), GFLOMT6 (SEQ. ID NO: 1597) and GFLOMT7 (SEQ. ID NO: 1598). In accordance herewith the O-methyltransferases may be used to methylate a first alkaloid compound and form a second alkaloid compound.

Accordingly, the present disclosure further includes in at least one aspect at least one embodiment of a method of making an alkaloid compound, comprising:

(a) providing a first alkaloid compound;

(b) contacting the alkaloid compound with an O-methyltransferase and/or and N-methyltransferase under reaction conditions that permit methylation of the alkaloid compound to form a second alkaloid compound;

wherein the first alkaloid compound has the chemical formula:

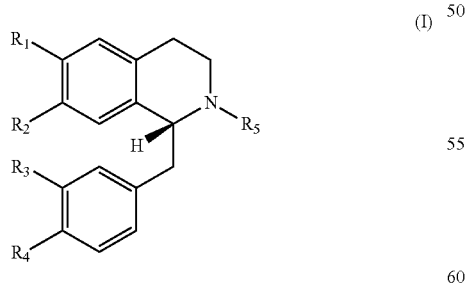

(I)

wherein $R_1$, $R_2$, $R_3$ and $R_4$ each independently or simultaneously represent a hydroxyl group or a methoxy group, with the proviso that $R_1$, $R_2$, $R_3$ and $R_4$ do not each simultaneously represent a methoxy group, and wherein $R_5$ represents a hydrogen atom or a methyl group; and wherein the second alkaloid compound has the chemical formula:

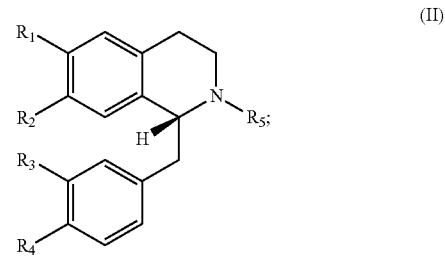

(II)

and wherein $R_1$, $R_2$, $R_3$ and $R_4$ each independently or simultaneously represent a hydroxyl group or a methoxy group, with the proviso that at least one of $R_1$, $R_2$, $R_3$ and $R_4$ represents a methoxy group, and wherein $R_5$ represents a hydrogen atom or a methyl group.

Referring to FIG. 9, in certain embodiments, the first alkaloid compound is a compound selected from the group consisting of Norlaudanosoline, 6-O-Methyl-norlaudanosline, Norreticuline, Norlaudanine, 6-O-Methyl-laudanosline, Reticuline, Norreticuline, Laudanine, Laudanosine, Tetrahydro-papaverine, Codamine and Norcodamine.

Referring to FIG. 9 and FIG. 10, in certain embodiments, the second alkaloid compound is an compound selected from the group consisting of 6-O-Methyl-norlaudanosline, Norreticuline, Norlaudanine, 6-O-Methyl-laudanosline, Reticuline, Norreticuline, Laudanine, Laudanosine, Tetrahydropapaverine, Codamine, 6,7-O,O-Dimethyllaudanosoline, Norcodamine and Norientaline or mixtures thereof.

The present disclosure further includes, in at least one aspect at least one embodiment of a method of making an alkaloid compound, comprising:

(a) providing a first alkaloid compound;

(b) contacting the alkaloid compound with an O-methyltransferase under reaction conditions that permit methylation of the alkaloid compound to form a second alkaloid compound;

wherein the first alkaloid compound has the chemical formula:

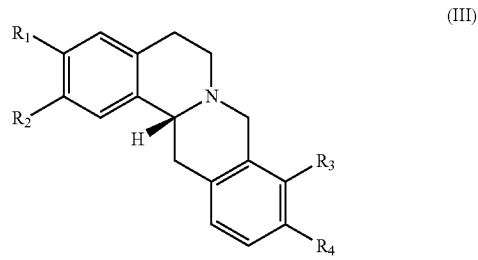

(III)

wherein $R_1$, $R_2$, $R_3$ and $R_4$ each independently or simultaneously represent a hydroxyl group or a methoxy group, with the proviso that $R_1$, $R_2$, $R_3$ and $R_4$ do not each simultaneously represent a methoxy group;

and wherein the second alkaloid compound has the chemical formula:

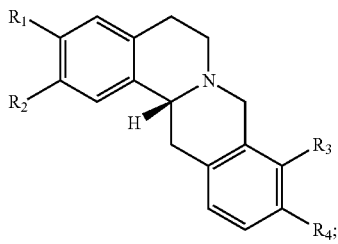

(IV)

and wherein $R_1$, $R_2$, $R_3$ and $R_4$ each independently or simultaneously represent a hydroxyl group or a methoxy group, with the proviso that at least one of $R_1$, $R_2$, $R_3$ and $R_4$ represents a methoxy group.

Referring to FIG. 10, in certain embodiments, the first alkaloid compound is a compound from selected from the group consisting of Tetrahydrocolumbamine and Scoulerine.

Referring to FIG. 10, in certain embodiments, the second alkaloid compound is a compound from selected from the group consisting of Tetrahydrocolumbamine, Tetrahydropalmatrubine and Tetrahydropalmatine.

In certain embodiments, the first alkaloid compound is Norlaudanosoline, the second alkaloid compound is 6-O-Methyl-norlaudanosline or Norreticuline and the O-methyltransferase is GFLOMT1 (SEQ. ID NO: 1592).

In certain embodiments, the first alkaloid compound is Norlaudanosoline, the second alkaloid compound is 6-O-Methyl-norlaudanosline and the O-methyltransferase is GFLOMT2 (SEQ. ID NO: 1593).

In certain embodiments, the first alkaloid compound is Norlaudanosoline, the second alkaloid compound is or Norcodamine and the O-methyltransferase is GFLOMT1 (SEQ. ID NO: 1592).

In certain embodiments, the first alkaloid compound is Norlaudanosoline, the second alkaloid compound is Norcodamine and/or Tetrahydropapaverine and the O-methyltransferase is GFLOMT2 (SEQ. ID NO: 1593).

In certain embodiments, the first alkaloid compound is 6-O-Methyl-norlaudanosline, the second alkaloid compound is Norreticuline and/or Norcodamine the methyltransferase is GFLOMT1 (SEQ. ID NO: 1592).

In certain embodiments, the first alkaloid compound is Norreticuline, the second alkaloid compound is Norlaudanine and the methyltransferase is GFLOMT6.

In certain embodiments, the first alkaloid compound is 6-O-Methyl-laudanosline, the second alkaloid compound is Reticuline and/or Codamine and the methyltransferase is GFLOMT1 (SEQ. ID NO: 1592).

In certain embodiments, the first alkaloid compound is 6-O-Methyl-laudanosline, the second alkaloid compound is Reticuline, Orientaline and/or Codamine and the methyltransferase is GFLOMT2 (SEQ. ID NO: 1593).

In certain embodiments, the first alkaloid compound is Reticuline, the second alkaloid compound is Codamine and the methyltransferase is GFLOMT2 (SEQ. ID NO: 1593).

In certain embodiments, the first alkaloid compound is Reticuline, the second alkaloid compound is Laudanine and/or Laudanosine and the methyltransferase is GFLOMT6 (SEQ. ID NO: 1597).

In certain embodiments, the first alkaloid compound is Norreticuline, the second alkaloid compound is Norcodamine and the methyltransferase is GFLOMT6.

In certain embodiments, the first alkaloid compound is Reticuline, the second alkaloid compound is Codamine and the methyltransferase is or GFLOMT6 (SEQ. ID NO: 1597).

In certain embodiments, the first alkaloid compound is 6-O-methyllaudanosoline, the second alkaloid compound is 6,7-O—O-dimethyllaudanosoline, and the methyltransferase is GLFOMT6 (SEQ. ID NO: 1597).

In certain embodiments, the first alkaloid compound is Norreticuline, the second alkaloid compound is tetrahydropapaverine and the methyltransferase is GFLOMT6 (SEQ. ID NO: 1597).

In further embodiments, the present disclosure provides, in at least one aspect, at least one embodiment of making an alkaloid compound, comprising:
(a) providing a first alkaloid compound;
(b) contacting the alkaloid compound with an O-methyltransferase under reaction conditions that permit methylation of the alkaloid compound to form a second alkaloid compound;

wherein the first alkaloid compound is selected from the group consisting of Scoulerine and Tetrahydrocolumbamine, and the second alkaloid compound is selected form the group consisting of Tetrahydropalmatrubine, Tetrahydropalmatine, Orientaline, Nororientaline and tetraydrocolumbamine.

In certain embodiments, the first alkaloid compound is Scoulerine, the second alkaloid compound is Tetrahydropalmatrubine and/or tetrahydropalmatine and the methyltransferase is GFLOMT1 (SEQ. ID NO: 1592).

In certain embodiments, the first alkaloid compound is Tetrahydrocolumbine, the second alkaloid compound is Tetrahydropalmatine and the methyltransferase is GFLOMT1 (SEQ. ID NO: 1592).

In certain embodiments, the first alkaloid compound is 6-O-methyl norlaudanosoline, the second alkaloid compound is Nororientaline and the methyltransferase is GFLOMT2 (SEQ. ID NO: 1593).

In certain embodiments, the first alkaloid compound is 6-O-methyl laudanosoline, the second alkaloid compound is Orientaline and the methyltransferase is GFLOMT2 (SEQ. ID NO: 1593).

In certain embodiments, the first alkaloid compound is Norlaudanosoline, the second alkaloid compound is Nororientaline and the methyltransferase is GFLOMT2 (SEQ. ID NO: 1593).

In certain embodiments, the first alkaloid compound is Scoulerine, the second alkaloid compound is Tetrahydropalmatrubine and/or tetrahydroplamatine and the methyltransferase is GFLOMT2 (SEQ. ID NO: 1593).

In certain embodiments, the first alkaloid compound is Tetrahydrocolumbine, the second alkaloid compound is Tetrahydropalmatine and the methyltransferase is GFLOMT1 (SEQ. ID NO: 1592).

In certain embodiments, the first alkaloid compound is Scoulerine, the second alkaloid compound is Tetrahydrocolumbamine and/or tetrahydropalmatine and the methyltransferase is GFLOMT6 (SEQ. ID NO: 1597).

In certain embodiments, the first alkaloid compound is Tetrahydrocolumbine, the second alkaloid compound is Tetrahydropalmatine and the methyltransferase is GFLOMT6 (SEQ. ID NO: 1597).

In certain embodiments, the first alkaloid compound is Scoulerine, the second alkaloid compound is Tetrahydrocolumbine and/or tetrahydropalmatrubine and the methyltransferase is GFLOMT7 (SEQ. ID NO: 1598).

In certain embodiments the first alkaloid compound is Tetrahydrocolumbamine, the second alkaloid compound is Tetrahydropalmatine and the methyltransferase is GFLOMT7 (SEQ. ID NO: 1598).

In further embodiments, mixtures of O-methyltransferases and/or N-methyltransferases may be used.

In certain embodiments, the first alkaloid compound is Norlaudanosoline, the second alkaloid compound is norcodamine and/or tetrahydropapaverine, and the methyltransferase is a mixture of GFLOMT1 (SEQ. ID NO: 1592) and GLFOMT2 (SEQ. ID NO: 1593).

In certain embodiments, the first alkaloid compound is Norlaudanosoline, the second alkaloid compound is codamine and/or reticuline, and the methyltransferase is a mixture of GFLOMT1 (SEQ. ID NO: 1592) and CNMT (e.g. SEQ. ID NO: 1327-SEQ. ID. NO: 1332 or SEQ. ID NO: 1749).

In certain embodiments, the first alkaloid compound is Norlaudanosoline, the second alkaloid compound is orientaline, laudanosine, codamine and/or reticuline, and the methyltransferase is a mixture of GFLOMT2 (SEQ. ID NO: 1593) and CNMT (e.g. SEQ. ID NO: 1327-SEQ. ID NO: 1332 or SEQ. ID NO: 1749).

In certain embodiments, the first alkaloid compound is Norlaudanosoline, the second alkaloid compound is orientaline, laudanosine, codamine and/or reticuline, and the methyltransferase is a mixture of GFLOMT2 (SEQ. ID NO: 1593), GFLOMT1 (SEQ. ID NO: 1592) and CNMT (e.g. SEQ. ID NO: 1327-SEQ. ID NO: 1332 or SEQ. ID NO: 1749).

In certain embodiments, the first alkaloid compound is Norlaudanosoline, the second alkaloid compound is norcodamine and/or tetrahydropapaverine, and the methyltransferase is a mixture of GFLOMT1 (SEQ. ID NO: 1592) and GLFOMT6 (SEQ. ID NO: 1597).

In certain embodiments, the first alkaloid compound is Norlaudanosoline, the second alkaloid compound is norientaline, norcodamine and/or tetrahydropapaverine, and the methyltransferase is a mixture of GFLOMT2 (SEQ. ID NO: 1593) and GLFOMT6 (SEQ. ID NO: 1597).

In certain embodiments, the first alkaloid compound is Norlaudanosoline, the second alkaloid compound is nororientaline, norcodamine and/or tetrahydropapaverine, and the methyltransferase is a mixture of GFLOM1 (SEQ. ID NO: 1592), GFLOMT2 (SEQ. ID NO: 1593) and GLFOMT6 (SEQ. ID NO: 1597).

In certain embodiments, the first alkaloid compound is Norlaudanosoline, the second alkaloid compound is reticuline, codamine, norcodamine, laudanine and/or laudanosine, and the methyltransferase is a mixture of GFLOM1 (SEQ. ID NO: 1592), GFLOMT6 (SEQ. ID NO: 1597) and CNMT (e.g. SEQ. ID NO: 1327-SEQ. ID NO: 1332 or SEQ. ID NO: 1749).

In certain embodiments, the first alkaloid compound is Norlaudanosoline, the second alkaloid compound is orientaline, reticuline, codamine, laudanine and/or laudanosine, and the methyltransferase is a mixture of GFLOM1 (SEQ. ID NO: 1592), GFLOMT2 (SEQ. ID NO: 1593), GFLOMT6 (SEQ. ID NO: 1597) and CNMT (e.g. SEQ. ID NO: 1327-SEQ. ID NO: 1332 or SEQ. ID NO: 1749).

In certain embodiments, the first alkaloid compound is Norlaudanosoline, the second alkaloid compound is reticuline, codamine, norcodamine, laudanine and/or laudanosine, and the methyltransferase is a mixture of GFLOM1 (SEQ. ID NO: 1592), GFLOMT6 (SEQ. ID NO: 1597) and CNMT (e.g. SEQ. ID NO: 1327-SEQ. ID NO: 1332; or SEQ. ID NO: 1749).

The foregoing embodiments of the present disclosure may be performed in-vitro or in-vivo.

In embodiments where in-vitro reactions are performed, the first alkaloid is brought in contact with catalytic quantities of the OMT and/or NMT enzymes under reaction conditions permitting an enzyme catalyzed chemical conversion of the first alkaloid under in vitro reaction conditions. Under such in vitro reaction conditions the initial reaction constituents are provided in more or less pure form and are mixed under conditions that permit the requisite chemical reactions to substantially proceed. Substantially pure forms of the initial alkaloid may be purchased. (S)-Reticuline, for example, may be purchased (e.g. from Santa Cruz Biotechnology Inc.) as a substantially pure chemical compound, chemically synthesized from precursor compounds, or isolated from natural sources including *Papaver somniferum* and other members of the Papaveraceae, Lauraceae, Annonaceae, Euphorbiaceae or Moraceae families of plants comprising such compounds as desired. In accordance herewith, more or less pure forms of the enzymes may be isolated from natural sources, including, but not limited to, *Papaver somniferum, Papaver bracteatum* and *Papaver rhoeas*, or they may be prepared recombinantly, or synthetically.

In embodiments where in-vivo reactions are performed, a first alkaloid is brought in contact with catalytic quantities of one or more of the OMT and/or NMT enzymes under reaction conditions permitting an enzyme catalyzed chemical conversion of the alkaloid derivative under in vivo reaction conditions. Under such in vivo reaction conditions living cells are modified in such a manner that they produce can convert the first alkaloid. In certain embodiments, the living cells are microorganisms, including bacterial cells and fungal cells. In other embodiments, the living cells are multicellular organisms, including plants and plant cell cultures.

In one embodiment, the living cells are selected to be host cells not naturally capable of capable of producing the second alkaloid. In another embodiment, the host cells are naturally capable of producing the second alkaloid but at levels that are lower than desirable. Such cells include, without limitation, bacteria, yeast, other fungal cells, plant cells, or animal cells. In embodiments where mixtures of enzymes are used cells comprising these enzymes may be mixed.

EXAMPLES

Hereinafter are provided examples of specific embodiments of the present disclosure, as well as embodiments representing the compositions of the present disclosure. The examples are provided for illustrative purposes only, and are not intended to limit the scope of the present disclosure in any way.

Example 1—Isolation of cDNA Candidate Polynucleotides from 20 Plant Species

The Trizol method was used to extract total RNA from plant organs and tissues (Chomczynski and Sacchi, 1987). When the polysaccharide and polyphenolic content was high, such as in roots or rhizomes, a modified CTAB method was used (Desgagné-Penix et al., 2010). The quality and quantity of isolated total RNA were evaluated on the basis of UV absorption ratios (i.e. 260/280 nm and 260/230 nm). All the samples showed a 260/280 nm ratio of between 1.9 and 2.1, and a 260/230 nm ratio in the range of 2.0 to 2.5.

Poly(A)+ RNA purification, cDNA library preparation, emulsion-based PCR (emPCR) and sequencing was performed at the McGill University and Génome Québec Innovation Centre (Montréal, Canada). The RNA content in all samples was quantified using a NanoDrop ND-1000 spectrophotometer (Thermo Scientific). RNA samples were further analyzed using an RNA 6000 Nano chip on a BioAnalyzer 2100 (Agilent Technologies) to validate RNA quality. Only samples with a BioAnalyzer RNA Integrity Number (RIN) of 7.5 or greater were used for sequencing. Poly(A)$^+$RNA was purified from 20-40 µg of total RNA by two rounds of selection using oligo (dT) attached to magnetic beads and a Dynabeads mRNA Purification kit (Invitrogen). The cDNA libraries for Roche-454 pyrosequencing were constructed from 200 ng of mRNA using a cDNA Rapid Library kit (Roche) and subsequently amplified by emPCR as per the manufacturer's instructions. After amplification, the DNA carrying beads for each library were loaded onto one-half of a PicoTiterPlate and subjected to Roche-454 GS-FLX Titanium pyrosequencing. Image and signal processing of the raw output data was performed using GS Run Processor. Sequence reads with high-quality scores were written into Standard Flowgram Format (SFF) files.

The cDNA libraries for Illumina GA sequencing were constructed from 10 µg of total RNA using the TruSeq Stranded mRNA Sample Prep Kit (Illumina) according to the manufacturer's instructions. The quality and average length of cDNAs in each library were determined using a High Sensitivity DNA (Agilent Technologies) chip on a 2100 Bioanalyzer. For Illumina GA sequencing, 7 pmol of each library containing cDNA with lengths from 600 to 1200 base pairs (bp) were loaded into one lane of the flow cell to generate approximately 750,000 clusters per mm$^2$. HCS 1.4 and CASAVA 1.6-1.8 suite were used to obtain base calls and raw fastq reads.

Quality scores and header information were extracted from SFF files generated from the 454 data. The pre-processing pipeline included several cleaning procedures, including clipping of adapter/primer sequences and window-based trimming of reads with Phred quality scores of less than 22. Low-complexity regions, including homopolymers were masked along with repeat regions identified based on similarity to the following: the RepBase14 database (Jurka et al., 2005), the Viridiplantae subset of NCBI reference sequences (Refseq), and the TIGR plant repeat database (Ouyang and Buell, 2004). Ribosomal RNA (rRNA) and ribosomal protein reference sets for related species were downloaded from NCBI and SILVA databases (Pruesse et al., 2007). Reads identified as rRNA and ribosomal protein sequences, and those shorter than 100 bp (not including masked regions) were removed from each 454 database. The Scylla component of the Paracel Filtering Package (PFP) (Paracel Inc, Pasadena, Calif.) was used to perform these steps.

Initial quality assessment for Illumina GA sequence data was based on FastQC www.bioinformatics.babraham.ac.uk/projects/fastqc) statistics, and Cut-adapt (Martin and Wang, 2011) was used for adapter/primer trimming. Trimmed reads were further subjected to quality score conversion, trimming of reads with Phred quality scores of less than 25, and removal of read pairs with at least one member shorter than 35 bp using scripts written in-house. Read were also trimmed at the 5' end by 12-14 bp to account for bias associated with random priming. rRNA and ribosomal protein content was monitored by mapping the raw reads against the reference sets downloaded from NCBI and SILVA databases. No filtering step was applied if the composition was not substantial.

For 454 GS-FLX sequencing, assemblies of cleaned 454 sequence data were generated using MIRA (version 3.2) (Chevreux et al. 2004). The pre-processing functions in MIRA (Chevreux et al. 2004) were disabled and analyses were performed using the 'accurate' setting. Other de novo assemblers, Paracel Transcript Assembler (Paracel Inc), CLC assembly cell (CLC bio, Cambridge Mass.), and Newbler v2.3 (Margulies et al., 2005) were also evaluated by comparing assembly statistics. MIRA produced the largest number of contigs over 1000 bp using the highest proportion of 454 reads.

Short-read Illumina GA data were assembled using Velvet-Oases v0.1.16 (Zerbino and Birney, 2008). Optimal assembly of contigs in each database and representing a wide dynamic range of gene expression was acquired using a combined k-mer assembly approach. The pipeline generated eight parallel Oases runs for each paired-end read set using incremental k-mer settings increasing by units of 5 between 37 to 67. The generation of multiple copies of similar transcripts was expected among the different k-mer runs when merging the eight assemblies. The clustering tool CD-HIT-EST (Li and Godzik, 2006) was used to reduce redundancy by clustering nearly identical (greater than 99%) transcripts and extracting the longest representative within each cluster. The non-redundant pool of transcripts was further assembled using CAP3 (Huang and Madan, 1999) to combine contigs with significant overlaps (minimum 95% identity over at least 50 bp). Final assemblies were completed after contigs of less than 300 bp were discarded.

Annotation of the 20 assembled transcriptome datasets was performed using the Magpie Automated Genomics Project Investigation Environment (MAGPIE) (Gaasterland and Sensen, 1996). MAGPIE automates sequence similarity searches against major public and internal target databases. TimeLogic Decypher Biocomputing systems www.timelogic.com were used to significantly accelerate similarity searches. Specifically, the Time-Logic Tera-BLAST algorithm was used to compare transcripts to the NCBI databases NR (non-redundant) and the viridiplantae subset of RefSeq (Pruitt et al., 2007). An expected e-value of 1e-3 and a minimum alignment length of 30 bp were used. To obtain motif-level information, accelerated Hidden Markov Model (HMM) searches were performed against local instances of Interpro HMM libraries at an e-value of 1e-10. The NCBI Conserved Domain Database (CDD) was also queried using RPS-BLAST for additional annotation information.

To coordinate all search results for each contig, MAGPIE ranked individual hits into three tiers of confidence. For BLAST results, e-value cutoffs were set at 1e-35, 1e-15, and 1e-5 for evidence levels 1, 2 and 3 respectively. For HMM results, e-value cutoffs were 1e-20, 1e-14 and 1e-10 at percentage similarity requirements of 65, 45 and 25%, respectively. Putative functional descriptions were assigned to each contig by performing a weighted summary of search result annotations. Summaries were based on word frequency, lexical complexity and word length, in addition to the level and type of evidence, and the taxonomic distance between the subject and the query species. GO annotations and EC numbers were compiled from GIDs extracted from level-1 evidence and attached to individual contigs as additional functional information. Contigs were subsequently cross-mapped to one another based on common GO terms and level-1 evidence. As a step towards the incorporation of metabolomics data, putative transcript data was mapped to KEGG metabolic pathways based on EC numbers. A summary page holding all evidence and annotation was generated for each contig in MAGPIE.

Annotated contigs were available for further analysis after the assembly and annotation of each sequence dataset. ESTScan (Lottaz et al., 2003) is a statistical hidden Markov model (HMM) program that can be used to discover patterns and was used for CDS detection. A refined HMM model was built using a set of full-length coding sequences for training. To determine the training set, the annotation evidence for each contig within an assembly was examined on all six open reading frames. The frame with the longest length of annotated sequence was scanned further. If the length of annotation within the selected frame was greater than 75% of the original contig length and contained putative start and stop codons, this frame was saved as a training set member. To ensure that the selected CDS has the maximum possible length, another scan was extended to flanking regions to search for possible start and stop codons.

After the double scanning was applied to every contig in an assembly, a set of putative full-length coding sequences was collected. This full-length coding sequence dataset was used to train ESTScan to build the HMM model (Iseli et al., 1999). After building the model, ESTScan was applied again to predict a putative CDS for every contig of the assembly. The CDS dataset from ESTScan could contain partial coding regions; thus, scanning of the original contig and annotation was repeated for every CDS generated. When both start and stop codons were found in the original contig and the annotation was longer than 75% of the original contig length, this putative CDS was retained as a full-length putative CDS. In contrast, partial putative coding regions were removed. The full-length putative CDS dataset was then combined with the full-length coding region dataset used to train the HMM model. Duplicated sequences were removed to generate the final predicted CDS dataset. To conservatively estimate the intersect between predicted full-length CDS sets generated by 454 and Illumina, Mega BLAST (Zhang et al, 2000) was used to compare respective sets at an e-value cutoff of 0.

Gene expression levels were determined by quantifying the observed read abundance. Raw read counts were extracted from assembly files for each contig in the case of the 454 assemblies. For Illumina GA data, counts were estimated by re-mapping raw short reads to the assembled contigs using Bowtie (Langmead et al., 2009). The RNA-Seq by Expectation-Maximization (RSEM) package (Li and Dewey, 2011) was used to resolve ambiguous mappings and to perform final quantifications. Only paired-end reads that mapped to a common contig were considered. Normalization was done by calculating FPKM values (Fragments Per Kilobase of exon model per Million mapped reads) for each contig.

Example 2—Isolating cDNA Candidate Polynucleotides Encoding N-Methyltransferases Involved in Benzylisoquinoline Alkaloid Biosynthesis More than 2,500 BIAs, many of which possess potent pharmacological properties, have been identified in plants belonging mostly to the families Papaveraceae, Ranunculaceae, Berberidaceae and Menispermaceae (Ziegler and Facchini, 2008). Many of the enzymes involved in BIA biosynthesis have been identified from a limited number of plants including opium poppy (*Papaver somniferum*) and Japanese goldthread (*Coptis japonica*), yet the majority of catalysts responsible for the immense structural diversity of BIAS in other plants have not been characterized. Tapping into the vast biosynthetic potential of plants requires access to genes from a variety of species. The transcriptome databases from 20 BIA-producing species represent such a repository of unique biosynthetic genes responsible for the diverse alkaloid content of these plants. Based on the categorization of known BIA biosynthetic enzymes into discrete protein families (e.g. cytochromes P450, O- and N-methyltransferases, various NADPH-dependent reductases, FAD-linked oxidoreductases, acyl-CoA-dependent acetyltransferases and 2-oxoglutarate-dependent dioxygenases) numerous orthologous and paralogous candidate genes can be selected from these databases for functional characterization.

The utility of NGS-based transcriptome databases from related plant species for the identification of novel biosynthetic enzymes is shown by focusing on N-methylation as a common functional group modification in BIA metabolism. Three alkaloid type-specific N-methyltransferases (NMTs) have been been characterized: coclaurine N-methyltransferase (CNMT), tetrahydroprotoberberine N-methyltransferase (TNMT) and pavine N-methyltransferase (PavNMT) (FIG. 1) (Liscombe et al., 2009). (+)-Magnoflorine is an antimicrobial alkaloid produced in several plant species via the N-methylation of (S)-corytuberine (Minami et al., 2008). Although the enzyme responsible for the formation of the quaternary ammonium in (+)-magnoflorine has not been identified (FIG. 1), CNMT from *Coptis japonica* was reported to N-methylate a broad range of substrates including corytuberine (Minami et al., 2008). Among the 20 BIA-producing plant species listed in TABLES 2-4, *Glaucium flavum* is known to accumulate substantial quantities of (+)-magnoflorine (Novák and Slavík, 1974) suggesting that an efficient corytuberine N-methyltransferase is represented among the NMT homologs in the transcriptome database for this plant. A phylogenetic tree was constructed using predicted amino acid sequences of the NMT homologs from all 20 BIA-producing species (TABLES 2-4) and several functionally characterized NMTs from related plants (FIG. 2). Six full-length paralogs distributed in three different NMT subclades were identified from the *G. flavum* 454 and Illumina GA sequence databases. Based on the extensive sequence similarity, most of the candidate genes are expected to encode NMTs involved in BIA metabolism. However, empirical enzyme characterization is required to confirm precise catalytic function. For example, GfNMT1 is the most likely CNMT functional ortholog in *G. flavum*, GfNMT2 and GfNMT3 are expected to exhibit TNMT activities with unique or overlapping substrate preferences, and GfNMT4 could function as a PavNMT (FIG. 2). In contrast, the predicted amino acid sequences of GfNMT5 and GfNMT6 are sufficiently distinct to suggest unique substrate specificities. Considering that (S)-corytuberine exhibits structurally similarity to the CNMT substrate (S)-coclaurine, GfNMT5 or GfNMT6 are candidates for a predicted corytuberine N-methyltransferase in *G. flavum* (FIG. 1). Gene triage is conducted for selecting priority candidates from large gene families.

Example 3—Confirming an Improved Polynucleotide Sequence Encoding N-Methyltransferases Involved in Benzylisoquinoline Alkaloid Synthesis Less than 2% of exogenous (R,S)-norlaudanosoline was converted to sanguinarine via a pathway of 10 genes from opium poppy (*Papaver somniferum*) re-assembled in yeast (*Saccharomyces cerevisiae*) (Fossati et al., 2014). An improvement in the conversion efficiency of the pathway can be achieved by substituting one or more specific opium poppy genes, with similar variants or known or unknown function from another plant species. More specifically, the opium poppy enzymes cheilanthifoline synthase (CYP719A25) and stylopine synthase (CYP719A20) can be replaced with SEQ. ID NO: 262 and SEQ. ID NO: 264, respectively, with the resulting yeast strain demonstrating an improvement in the conversion of exogenous (R,S)-norlaudanosoline to sanguinarine. Similarly, opium poppy tetrahydroprotoberberine cis-N-methyltransferase (TNMT) can be replaced with SEQ. ID NO: 445, resulting in further improvement in the conversion efficiency of the yeast strain.

Mining of transcriptome databases for the selected plant species generates hundreds of biosynthetic genes encoding enzymes with novel catalytic activities and variants with similar functions, but different biochemical features. Genes encoding variants display improved expression characteristics in plants and microorganisms, providing metabolic engineering options for the optimization of synthetic biosystems designed to produce high-value plant metabolites. The use of this technology, employing various combinations and permutations of biosynthetic genes to engineer multistep biosynthetic pathways in microorganisms, also accelerates the discovery of novel enzymes, and the reconstruction and optimization of natural and unnatural product pathways based on combinatorial biochemistry.

Various studies have partially reconstituted other plant natural product pathways in *Escherichia coli* or yeast (*Saccharomyces cerevisiae*) leading to the formation of taxadiene, a key isoprenoid intermediate in taxol biosynthesis, amorphadiene, the sesquiterpene olefin precursor to artemisinin (Martin et al., 2003), artemisinic acid, the immediate precursor to artemisinin (Ro et al., 2008), the diterpene fragrance precursors cis-abienol (Zerbe et al., 2012) and sclareol (Caniard et al., 2012). Nevertheless, the deployment of most plant metabolic pathways in microbial hosts still requires the isolation and functional characterization of many unknown biosynthetic genes. Even when all biosynthetic genes required for the formation of a specific compound have been isolated from one plant and reconstituted in a microorganism, the specific catalytic characteristics of each enzyme can be inappropriate for the efficient operation of the metabolic pathway in a heterologous system. In such cases, the overall metabolic flux will be limited by the enzyme step with the lowest catalytic efficiency. The availability of enzyme variants from a wide variety of plant species, as described in this disclosure, provides a possible empirical solution to such metabolic engineering bottlenecks.

Example 4—Identifying cDNA Candidate Polynucleotides Encoding O-Methyltransferases Involved in Benzylisoquinoline Alkaloid Biosynthesis Libraries containing cDNA sequences of 20 BIA-producing plant species were prepared and sequenced as described in Example 1. Within these libraries seven homologues of characterized O-methyltransferases (OMTs) involved in BIA biosynthesis were isolated from assembled 454 and Illumina GA databases (Xiao et al, 2013) of *Glaucium flavum* (GFLOMTs). The candidate selection strategy was based on a cutoff of 35% overall amino acid sequence identity with at least one functionally characterized OMT involved in BIA biosynthesis. Phylogenetic analysis showed that GFLOMT1-4 and GFLOMT6 formed separate clades with known OMTs (FIG. 3), whereas GFLOMT5 and GFLOMT7 formed a new clade. GFLOMT1 shares 77 and 71% amino acid sequence identities with Ps4'OMT2 from opium poppy and Cj4'OMT from *Coptis japonica*, respectively. GFLOMT2 shows 80 and 70% sequence identities with Ps6OMT from opium poppy and Cj6OMT from *C. japonica*, respectively. GFLOMT3 shares 63% sequence identities with Ps7OMT from opium poppy and GFLOMT4 shows 38% sequence identity with CjCoOMT from *C. japonica*. GFLOMT6 shares 60 and 63% sequence identities with PsSOMT from opium poppy and CjSOMT from *C. japonica*, respectively. In contrast, GFLOMT5 and GFLOMT7 display only 42 and 44% sequence identity with the nearest neighbor CjSOMT from *C. japonica*, respectively.

Example 5—Expression of O-methyltransferases

Full-length cDNAs for the seven GFLOMT candidates (see: Example 6) were cloned into the pRSETA expression vector with an N-terminal His_tag translational fusion and expressed in *E. coli*. Recombinant GFLOMTs were purified from total protein extracts using a cobalt-affinity resin. All purified recombinant enzymes displayed molecular weight values corresponding to expected protein sizes, as determined by SDS-PAGE (FIG. 4)

Example 6—Substrate Specificity of O-Methyltransferases

Substrate specificity of the seven FLOMT's was assessed using a range of different alkaloid substrates, notably (R,S)-norlaudanosine; (R,S)-6-O-Methylnorlaudanosoline; (R,S)-6-O-Methyllaudanosoline; (R,S)-Norreticuline; (S)-Reticuline; (R,S)-Scoulerine; and (R,S)-Tetrahydrocolumbamine. Results are shown in TABLE 5. In the presence of SAM, GFLOMT1 showed differential activity with all seven substrates. Norlaudanosoline was the preferred substrate displaying 96% conversion in the standard OMT assay, however, 6-O-methylnorlaudanosoline (87%) and 6-O-methyllaudanosoline (68%) were also efficiently converted. Scoulerine (32%), tetrahydrocolumbamine (19%), and reticuline (6%) were also accepted, but with relatively lower conversion efficiencies. Norlaudanosoline was also the best substrate for GFLOMT2 (100%), whereas 6-O-methylnorlaudanosoline (1%) and 6-O-methyllaudanosoline (14%) were not efficiently converted. In further contrast to GFLOMT1, scoulerine (75%), tetrahydrocolumbamine (32%), and reticuline (22%) were accepted with relatively higher conversion efficiencies. Scoulerine was the preferred substrate for GFLOMT6 (100%), with reticuline (97%) and tetrahydrocolumbamine (90%) also efficiently converted, and norreticuline (36%) and 6-O-methyllaudanosoline (23%) accepted at moderate levels. GFLOMT6 did not accept norlaudanosoline or 6-O-methylnorlaudanosoline. GFLOMT7 showed relatively low activity with scoulerine (12%) and tetrahydrocolumbamine (8%), but did not accept other BIAs. GFLOMT3, GFLOMT45, and GFLOMT5 did not show activity with any of the tested substrates. Kinetic analyses with preferred substrates yielding single reaction products showed that the three most effective GFLOMTs followed the Michaelis-Menton model. GFLOMT1 exhibited a $K_m$ of 12 µM for 6-O-methylnorlaudanosoline, GFLOMT2 showed a $K_m$ of 15 µM for norlaudanosoline, GFLOMT6 showed a $K_m$ of 22 µM for scoulerine, Catalytic efficiencies ($k_{cat}/K_m$) were relatively high for all three conversions.

Example 7—In-Vitro Reaction Products Formed by O-Methyltransferases

The reaction products formed using GFLOMT1, GFLOMT2, GFLOMT6 and GFLOMT7 were analyzed. Enzyme assays were subjected to positive-mode electrospray ionization (ESI[+]) LC-MS/MS for reaction product characterization, including collision-induced dissociation (CID) fragmentation analysis. ESI[+]-CID of 1-benzylisoquinoline and protoberberine alkaloids at low ionization energy yields isoquinoline and/or benzyl moieties as major ion fragments. Using the ESI[+]-CID spectra of authentic standards (TABLE 6), the identity of recombinant GFLOMT reaction products was determined (TABLE 7). Positions of new O-methyl groups could be inferred from the increased m/z (in multiples of 14 Da) of dissociated isoquinoline and benzyl ion fragments even in the absence of authentic standards, although most were available.

GFLOMT1

Incubation of GFLOMT1 with norlaudanosoline (m/z 288) yielded two major peaks with m/z 302 at 2.62 min and m/z 316 at 2.95 min (FIG. 5A), suggesting single and double O-methylation events, respectively. The parent ion of m/z 302 produced an ESI[+]-CID spectrum corresponding to authentic 6-O-methylnorlaudanosoline, whereas the parent ion of m/z 316 produced an ESI[+]-CID spectrum matching that of norreticuline. Assays containing GFLOMT1 and 6-O-methylnorlaudanosoline (m/z 302) generated major and minor products of m/z 316 and m/z 330, with ESI[+]-CID spectra corresponding to norreticuline and norcodamine, respectively (FIG. 5B). Although an authentic standard for norcodamine was not available, compound identity could be inferred. Compared with the ESI[+]-CID spectrum of 6-O-methylnorlaudanosoline, which displays the fragment ions m/z 178 (isoquinoline moiety) and m/z 123 (benzyl moiety), the m/z 330 reaction product yielded major fragment ions of m/z 178 and m/z 151 (increase of 28 Da), the latter of which corresponds to a 3- and 4-O-methylated benzyl moiety. Incubation of GFLOMT1 with 6-O-methyllaudanosoline (m/z 316) yielded major and minor products with m/z 330 at 2.99 min and m/z 344 at 3.17 min, corresponding to single and double O-methylation events, respectively (FIG. 5C). The m/z-330 parent ion produced an ESI[+]-CID spectrum corresponding to authentic reticuline, whereas the double O-methylated m/z-344 parent ion yielded an ESI[+]-CID spectrum matching that of codamine. In assays containing GFLOMT1 and reticuline, a minor product of m/z 344 with an ESI[+]-CID spectrum corresponding codamine was also produced (FIG. 5D). The major and minor products resulting from the incubation of GFLOMT1 with scoulerine showed parent masses of m/z 342 and m/z 356, with ESI[+]-CID spectra corresponding to tetrahydropalmatrubine and tetrahydropalmatine (FIG. 5E). An authentic standard for tetrahydropalmatrubine was not available, however, product identification was inferred from the 14-Da increase in the isoquinoline moiety of scoulerine (m/z 178) to m/z 192. In assays containing GFLOMT1 and tetrahydrocolumbine a minor product was generated with a parent mass of m/z 356 and an ESI[+]-CID spectrum corresponding to tetrahydropalmatine (FIG. 5F).

GFLOMT2

GFLOMT2 efficiently converted norlaudanosoline (m/z 288) to a product with m/z 302, which yielded an ESI[+]-CID spectrum corresponding to 6-O-methylnorlaudanosoline (FIG. 6A). In contrast, GFLOMT2 incubated with 6-O-methylnorlaudanosoline generated a minor product with m/z 316 (FIG. 6B), which was inferred as nororientaline based on the detection of major fragment ions of m/z 178 (isoquinoline moiety) and m/z 137 (3'-O-methylated benzyl moiety). The different retention time compared with norreticuline (i.e. 4'-O-methylated 6-O-methylnorlaudanosoline) confirmed 3'-rather than 4'-O-methylation. Incubation of GFLOMT2 with 6-O-methyllaudanosoline (m/z 316) yielded three products with m/z 330 at 2.85 min, m/z 330 at 2.98 min, and m/z 344 at 3.15 min, indicating both single and double O-methylation events (FIG. 6C). The identity of the m/z-330 parent ion at 2.85 min was inferred as orientaline based on the detection of major fragment ions of m/z 192 (isoquinoline moiety) and m/z 137 (3'-O-methylated benzyl moiety). The different retention time compared with reticuline (i.e. 4'-O-methylated 6-O-methyllaudanosoline and the m/z-330 parent ion at 2.98 min) confirmed 3'-rather than 4'-O-methylation. The double O-methylation product corresponded to a parent ion of m/z-344 parent ion yielded an ESI[+]-CID spectrum corresponding to codamine. The minor GFLOMT2 reaction product with reticuline showed a parent mass of m/z 344 and ESI[+]-CID spectrum corresponding to codamine (FIG. 6D). Incubation of GFLOMT2 with scoulerine (m/z 328) yielded major and minor products with m/z 342 and m/z 356, identified as tetrahydropalmatrubine and tetrahydropalmatine, respectively (FIG. 6E). The reaction product of GFLOMT2 incubated with tetrahydrocolumbine showed a parent mass of m/z 356, which was also identified as tetrahydropalmatine (FIG. 6F).

FLOMT6

Incubation of GFLOMT6 with 6-O-methyllaudanosoline (m/z 316) yielded a reaction product with m/z 330 (FIG. 7A), which was inferred as 6,7-O,O-dimethyllaudanosoline based on ESI[+]-CID spectrum and a unique retention time. Compared with the ESI[+]-CID spectrum of 6-O-methyllaudanosoline, which shows major fragment ions of m/z 192 and m/z 123, the m/z 330 product yielded fragment ions of m/z 206 (7-O-methylated isoquinoline moiety) and m/z 123 (unchanged benzyl moiety). Incubation of GFLOMT6 with norreticuline (m/z 316) yielded two major and one minor reaction products with m/z 330 at 3.16 min, m/z 330 at 3.25 min, and m/z 344 at 3.43 min (FIG. 7B), corresponding to single and double O-methylation events. Identity of the m/z-330 parent ion at 3.16 min was inferred as norcodamine based on the ESI[+]-CID spectrum and unique retention time. The m/z-330 parent ion at 3.25 min produced and ESI[+]-CID spectrum corresponding to norlaudanine. The minor double O-methylation product with m/z 344 produced an ESI[+]-CID spectrum matching that of tetrahydropapaverine. GFLOMT6 efficiently converted reticuline (m/z 330) to three products with m/z 344 at 3.17 min, m/z 344 at 3.24 min, and m/z 358 at 3.43 min (FIG. 7C), indicating single and double O-methylation events. The m/z-344 parent ions at 3.17 and 3.24 min yielded ESI[+]-CID spectra corresponding to codamine and laudanine. The double O-methylation product with a parent ion of m/z 358 generated an ESI[+]-CID spectrum matching that of laudanosine. GFLOMT6 efficiently converted scoulerine (m/z 328) to two major reaction products with m/z 342 at 3.29 min, and m/z 356 at 3.59 min (FIG. 7D), corresponding to single and double O-methylation events, respectively. The m/z-342 parent ion produced an ESI[+]-CID spectrum corresponding to tetrahydrocolumbamine, whereas the m/z-356 parent ion yielded an ESI[+]-CID spectrum matching that of tetrahydropalmatine. Incubation of GFLOMT6 with tetrahydrocolumbine (m/z 342) generated a major product with m/z 356 and an ESI[+]-CID spectrum corresponding to tetrahydropalmatine (FIG. 7E).

FLOMT7

Incubation of GFLOMT7 with scoulerine (m/z 328) yielded two minor reaction products with m/z 342 at 3.33 min and m/z 342 at 3.44 min (FIG. 7F) with ESI[+]-CID spectra corresponding to tetrahydrocolumbine (i.e. methylated benzyl moiety of scoulerine) and tetrahydropalmatrubine (methylated isoquinoline moiety of scoulerine), respectively. The reaction product of GFLOMT7 incubated with tetrahydrocolumbine (m/z 342) generated a reaction product with m/z 356 and an ESI[+]-CID spectrum corresponding to tetrahydropalmatine (FIG. 7G).

Example 8—In Vivo Reaction Products Formed by O-Methyltransferases (R,S)-Norlaudanosoline was fed to mixed cultures of E. coli harboring different combinations and permutations of pGFLOMT1, pGFLOMT2, pGFLOMT6, and pCNMT to determine the in vivo efficiency of each OMT with both N-methylated and N-desmethyl 1-benzylisoquinolines (FIG. 8). Norlaudanosoline was not recovered in ethyl acetate extractions. The empty vector control showed that E. coli was inherently incapable of transforming norlaudanosoline to other BIAs (FIG. 8A). Transformation product identifications were determined using the ESI[+]-CID spectra of authentic standards and inferences described above, which are generally not repeated below.

Incubation of an E. coli strain harboring pGFLOMT1 with norlaudanosoline (m/z 288) yielded one compound identified as norcodamine (m/z 330) (FIG. 8B). In contrast, incubation of an E. coli strain harboring pGFLOMT2 with norlaudanosoline generated three products with m/z 316 at 2.85 min, m/z 330 at 3.15 min, and m/z 344 at 3.42 min (FIG. 8C) corresponding to nororientaline, norcodamine, and tetrahydropapaverine, respectively. Incubation of mixed E. coli strains harboring pGFLOMT1 and pGFLOMT2 with norlaudanosoline yielded compounds with m/z 330 at 3.15 min and m/z 344 at 3.42 min (FIG. 8D) corresponding to norcodamine and tetrahydropapaverine, respectively. Addition of an E. coli strain harboring pCNMT to this series altered the profile of products formed in all pGFLOMT combinations. Incubation of mixed E. coli strains harboring pGFLOMT1 and pCNMT with norlaudanosoline compounds with m/z 330 at 2.99 min and m/z 344 at 3.17 min identified as reticuline and codamine (FIG. 8E). Incubation of mixed E. coli strains harboring pGFLOMT2 and pCNMT with norlaudanosoline resulted in four compounds with m/z 330 at 2.85 min, m/z 330 at 2.98 min, m/z 344 at 3.16 min, and m/z 358 at 3.4 min corresponding to orientaline, reticuline, codamine, and laudanosine (FIG. 8F). Incubation of mixed E. coli strains harboring pGFLOMT1, pGFLOMT2, and pCNMT with norlaudanosoline also produced orientaline, reticuline, codamine, and laudanosine, but with an apparently higher yield compared with incubations lacking one of the strains (FIG. 8G).

Incubation of mixed E. coli strains harboring of pGFLOMT1 and pGFLOMT6 with norlaudanosoline yielded two products with m/z 330 at 3.14 min and m/z 344 at 3.43 min, corresponding to norcodamine and tetrahydropapaverine, respectively (FIG. 8H). Incubation of mixed E. coli strains harboring pGFLOMT2 and pGFLOMT6 with norlaudanosoline generated three compounds with m/z 316 at 2.87 min, m/z 330 at 3.14 min, m/z 344 at 3.43 min, identified as nororientaline, norcodamine, and tetrahydropapaverine, respectively (FIG. 8I). Combining E. coli strains harboring pGFLOMT1, pGFLOMT2, and pGFLOMT6, and incubating with norlaudanosoline only changed the relative abundance of nororientaline, norcodamine, tetrahydropapaverine (FIG. 8J), compared with the absence of pGFLOMT1 (FIG. 8I). However, addition of an E. coli strain harboring pCNMT to this series altered the profile of products generated via all pGFLOMT combinations. Incubation of mixed E. coli strains harboring pGFLOMT1, pGFLOMT6, and pCNMT, and incubation with norlaudanosoline produced five compounds with m/z 330 at 2.99 min, m/z 330 at 3.16 min, m/z 344 at 3.18 min, m/z 344 at 3.24 min, and m/z 358 at 3.42 min, identified as reticuline, norcodamine, codamine, laudanine, and laudanosine, respectively (FIG. 8K). Mixed E. coli strains harboring pGFLOMT2, pGFLOMT6, and pCNMT with norlaudanosoline yielded compounds with m/z 330 at 2.88 min, m/z 330 at 3 min, m/z 344 at 3.16 min, m/z 344 at 3.23 min, and m/z 358 at 3.42 min, corresponding to orientaline, reticuline, codamine, laudanine, and laudanosine, respectively (FIG. 8L). Finally, incubation of mixed E. coli strains harboring pGFLOMT1, pGFLOMT2, pGFLOMT6, and pCNMT with norlaudanosoline produced the same five compounds, but with an apparently higher yield than incubations lacking the E. coli strain harboring pGFLOMT1 (FIG. 8M).

While the present disclosure has been described with respect to what are presently considered to be the preferred examples, it is understood that the disclosure is not limited to the disclosed examples. To the contrary, the disclosure is intended to cover various modifications and equivalent arrangements included within the spirit of the appended claims.

All publications, patents and patent applications are incorporated by reference in their entirety to the same extent as if each individual publication, patent or patent application was specifically indicated to be incorporated by reference in its entirety.

TABLE 1

| Enzyme Name | Abbreviation | Exemplary SEQ ID NO (polynucleotide/amino acid) | Exemplary Substrate/Product |
|---|---|---|---|
| Norcoclaurine synthase | NCS | SEQ. ID. NO: 400/SEQ. ID. NO: 1261 | 4-Hydroxyphenylacetaldehyde and dopamine/(S)-Norcoclaurine |
| Norcoclaurine 6-O-methyltransferase | 6OMT | SEQ. ID. NO: 726/SEQ. ID. NO: 1672 | (R,S)-Norcauclaurine/(R,S)-Coclaurine |
| Reticuline 7-O-methyltransferase | 7OMT | SEQ. ID. NO: 730/SEQ. ID. NO: 1676 | (R,S)-Reticuline/(R,S)-Norreticuline |
| 3'-Hydroxy-N-methylcoclaurine 4'-O-methyltransferase | 4'OMT | SEQ. ID. NO: 776/SEQ. ID. NO: 1723 | (R,S)-3'-Hydroxy-N-methylcoclaurine/(R,S)-Reticuline |
| Norreticuline 7-O-methyltransferase | N7OMT | SEQ. ID. NO: 621/SEQ. ID. NO: 1567 | (R,S)-Norreticuline/(R,S)-7-O-methylnorreticuline |

TABLE 1-continued

| Enzyme Name | Abbreviation | Exemplary SEQ ID NO (polynucleotide/amino acid) | Exemplary Substrate/Product |
|---|---|---|---|
| Scoulerine 9-O-methyltransferase | SOMT | SEQ. ID. NO: 783/SEQ. ID. NO: 1730 | (S)-Scoulerine/(S)-Tetrahydrocolumbamine |
| Columbamine O-methyltransferase | CoOMT | SEQ. ID. NO: 718/SEQ. ID. NO: 1664 | (S)-Tetrahydrocolumbamine/(S)-tetrahydrodopalmatine |
| Coclaurine-N-methyltransferase | CNMT | SEQ. ID. NO: 446/SEQ. ID. NO: 1304 | (S)-Coclaurine/(S)-N-Methylcoclaurine |
| Tetrahydroprotoberberine cis-N-metyltransferase | TNMT | SEQ. ID. NO: 445/SEQ. ID. NO: 1303 | (S)-Stylopine/(S)-cis-N-Methylstylopine |
| Pavine N-methyltransferase | PavNMT | SEQ. ID. NO: 494 SEQ. ID. NO: 1352 | (+,−)-Pavine/(+/−)-N-Methylpavine |
| Berbamunine synthase | BS, CYP80A1 | SEQ. ID. NO: 98/SEQ. ID. NO: 1009 | (R,S)-N-Methylcoclaurine/Berbamunine |
| Corytuberine synthase | CTS, CYP80A1 | SEQ. ID. NO: 146/SEQ. ID. NO: 1002 | (S)-Reticuline/corytuberine |
| N-Methylcoclaurine 3'-hydroxylase | NMCH, CYP80B3 | SEQ. ID. NO: 137/SEQ. ID. NO: 962 | (S)-N-Methylcoclaurine/(S)-3'-Hydroxy-N-Methylcoclaurine |
| (S)-N-Methylstylopine 14-hydroxylase | MSH, CYP82N4 | SEQ. ID. NO: 147/SEQ.ID. NO: 1012 | (S)-cis-Methylstylopine/Protopine |
| Protopine 6-hydroxylase | P6H, CYP82N3 | SEQ. ID. NO: 176/SEQ. ID. NO: 1041 | Protopine/Dihydrosanguinerine |
| (S)-N-Methylcanadine 1-hydroxylase | NMCanH, CYP82Y1 | SEQ. ID. NO: 214/SEQ. ID. NO: 1079 | (S)-N-Methylcanadine/(S)-1-Hydroxy-N-Methylcanadine |
| Canadine synthase | CAS, CYP719A19 | SEQ. ID. NO: 283/SEQ. ID. NO: 1148 | (S)-Tetrahydrocolumbamine/(S)-Canadine |
| Cheilantofoline synthase | CFS, CYP719A25 | SEQ. ID. NO: 262/SEQ.ID. NO: 1127 | (S)-Scoulerine/(S)-Cheilantofoline |
| Stylopine synthase | SPS, CYP719A20 | SEQ. ID. NO: 264/SEQ. ID. NO: 1129 | (S)-Cheilantofoline/(S)-Stylopine |
| Salutaridine synthase | SalSyn, CYP719B1 | SEQ. ID. NO: 274/SEQ.ID. NO: 1139 | (R)-Reticuline/Salutaridine |
| Salutaridine reductase | SalR | SEQ. ID. NO: 789/SEQ. ID. NO: 1454 | Salutaridine/Salutaridinol |
| Salutaridine 7-O-acetyltransferase | SalAT | SEQ. ID. NO: 579/SEQ. ID. NO: 1443 | Salutaridinol/Thebaine |
| Thebaine 6-O-demethylase | T6ODM | PBRDIOX13 SEQ. ID. NO: 347/SEQ. ID. NO: 1212 | Thebaine/Codeinone |
| Thebaine 6-O-demethylase | T6ODM | PBRDIOX13 SEQ. ID. NO: 347/SEQ. ID. NO: 1212 | Oripavine/Morphinone |
| Codeine O-demethylase | CODM | PBRDIOX12 SEQ. ID. NO: 346/SEQ. ID. NO: 1211 | Codeine/Morphine |
| Codeine O-demethylase | CODM | PBRDIOX12 SEQ. ID. NO: 346/SEQ. ID. NO: 1211 | Thebaine/Oripavine |
| Protoberberine O-dealkylase | PODA | PBRDIOX11 SEQ. ID. NO: 345/SEQ. ID. NO: 1210 | Cryptopine/O-Demethylcryptopine |
| Codeinone reductase | COR | SEQ. ID NO: 34/SEQ. ID. NO: 903 | Codeinone/Codeine |
| Codeinone reductase | COR | SEQ. ID. NO: 34/SEQ. ID. NO: 903 | Morphinone/Morphine |
| Dihydrobenzophenanthridin oxidase | DBOX | SEQ. ID. NO: 373/SEQ. ID. NO: 1235 | Papaverine |
| (S)-Tetrahydroprotoberberine oxidase | STOX | SEQ. ID. NO: 387/SEQ. ID. NO: 1248 | (S)-Canadine/Berberine |
| Sanguinerine reductase | SanR | SEQ. ID. NO: 818/SEQ. ID. NO: 1484 | Sanguinerine/Dihydrosanguinerine |
| Noscapine synthase | NOS | SEQ. ID. NO: 521/SEQ. ID. NO: 1384 | Narcotinehemiacetal/Noscapine |
| 3-O-Acetylpapaveroxine carboxylesterase | CXE1 | SEQ. ID. NO: 562/SEQ. ID. NO: 1426 | 3-O-Acetylpapaveroxine/Narcotinehemiacetal |
| 1,13-Dihydroxy-N-methylcanadine 13-O-acetyltransferase | AT1 | SEQ. ID. NO: 61/SEQ. ID. NO: 930 | 1,13-Dihydroxy-N-methylcanadine/1-Hydroxy-13-O-acetyl-N-methylcanadine |

TABLE 2

| | | | | | Rocha GS-FLX Titanium | | | | | | Intersects between 454 and Illumina predicted full-length CDS |
|---|---|---|---|---|---|---|---|---|---|---|---|
| No. | Abbrev. | Plant | Tissue | SRA accession number | Number of raw reads | Number of cleaned reads | Average read length (bp) | Average transcript read depth (reads/bp) | Unigenes | Predicted full-length CDS | |
| 1 | AME | *Argemone mexicana* | Stem | SRX076322 | 579,575 | 511,923 | 406 | 8.0 | 25,499 | 14,446 | 8,010 |
| 2 | BTH | *Berberis thunbergii* | Root | SRX202153 | 728,069 | 721,524 | 340 | 6.2 | 41,672 | 12,312 | 6,129 |

TABLE 2-continued

| | | | | Rocha GS-FLX Titanium | | | | | | Intersects between 454 and Illumina predicted full-length CDS |
|---|---|---|---|---|---|---|---|---|---|---|
| No. | Abbrev. | Plant | Tissue | SRA accession number | Number of raw reads | Number of cleaned reads | Average read length (bp) | Average transcript read depth (reads/bp) | Unigenes | Predicted full-length CDS | |
| 3 | CMA | Chelidonium majus | Stem | SRS150402 | 504,849 | 406,742 | 347 | 7.1 | 23,678 | 10,312 | 8,296 |
| 4 | CMU | Cissampelos mucronata | Callus | SRX130678 | 721,691 | 714,978 | 376 | 7.3 | 35,166 | 14,300 | 9,877 |
| 5 | CTR | Cocculus trilobus | Callus | SRX130662 | 535062 | 625,283 | 327 | 5.2 | 34,783 | 11,784 | 127 |
| 6 | CCH | Corydalis chelanthifolia | Root | SRX078320 | 502,500 | 431,507 | 360 | 7.6 | 22,511 | 10,912 | 8,716 |
| 7 | ECA | Eschscholzia californica | Root | SRS160613 | 472,167 | 423,743 | 428 | 5.6 | 32,160 | 17,365 | 12,911 |
| 8 | GFL | Glaucium flavum | Root | SRS212395 | 648,604 | 540,433 | 396 | 8.1 | 26,520 | 12,084 | 8,199 |
| 9 | HCA | Hydrastis canadensis | Rhizome | SRS212407 | 685,239 | 440,063 | 254 | 8.8 | 23,809 | 10,801 | 7,617 |
| 10 | JDI | Jeffersonnia diphylla | Root | SRX202161 | 833,182 | 821,875 | 340 | 7.4 | 38,773 | 13,293 | 8,680 |
| 11 | MAQ | Mahonia aquifolium | Bark | SRX078960 | 506,160 | 442,484 | 289 | 5.1 | 36,429 | 11,802 | 495 |
| 12 | MCA | Menispermum canadense | Rhizome | SRX078321 | 443,738 | 392,619 | 378 | 5.7 | 36,399 | 8,858 | 3,956 |
| 13 | NDA | Nandina domestica | Root | SRX202162 | 832,375 | 821,728 | 372 | 6.4 | 45,387 | 18,367 | 11,138 |
| 14 | NSA | Nigella sativa | Root | SRX078325 | 1,326,496 | 1,203,320 | 318 | 9.1 | 50,508 | 19,551 | 10,457 |
| 15 | PBR | Papaver bracteatum | Stem | SRS180614 | 595,176 | 528,920 | 360 | 4.7 | 46,224 | 18,879 | 14,042 |
| 16 | SCA | Sanguinaria canadensis | Rhizome | SRS212403 | 653,689 | 571,622 | 417 | 6.7 | 25,652 | 11,787 | 9,514 |
| 17 | SDI | Stylophorum diphyllum | Stem | SRX078312 | 846,959 | 576,700 | 353 | 5.5 | 43,568 | 19,631 | 9,636 |
| 18 | TFL | Thalictrum flavum | Root | SRX039636 | 440,689 | 401,315 | 385 | 7.8 | 21,146 | 13,002 | 8,153 |
| 19 | TCO | Tinospora cordifolia | Callus | SRX130689 | 647,850 | 641,837 | 381 | 6.8 | 34,518 | 14362 | 9,403 |
| 20 | XSI | Xanthoriza simplicissima | Rhizome | SRX078324 | 978,176 | 729,767 | 265 | 6.3 | 42,969 | 15,995 | 7,107 |
| | | Average | | | 664,213 | 592,535 | 356 | 6.8 | 34,368 | 13,993 | 7,708 |

TABLE 3

| | | | | Illumina GA/HiSeq | | | | | |
|---|---|---|---|---|---|---|---|---|---|
| No. | Abbrev. | Plant | Tissue | SRA accession number | Number of raw reads | Number of cleaned reads | Average transcript read depth (reads/bp) | Unigenes | Predicted full-length CDS |
| 1 | AME | Argemone mexicana | Stem | SRX096074 | 79,936,080 | 50,819,736 | 39.1 | 75,101 | 32,940 |
| 2 | BTH | Berberis thunbergii | Root | SRX096075 | 70,074,022 | 64,584,658 | 53.1 | 88,302 | 24976 |
| 3 | CMA | Chelidonium majus | Stem | SRX096034 | 62,362,800 | 50,819,736 | 32.3 | 45,005 | 32,416 |
| 4 | CMU | Cissampelos mucronata | Callus | SRX130854 | 232,997,416 | 190,922,766 | 137.1 | 69,822 | 21,140 |
| 5 | CTR | Cocculus trilobus | Callus | SRX202432 | 220,956,972 | 190,682,284 | 69.0 | 84,793 | 3,773 |
| 6 | CCH | Corydalis chelanthifolia | Root | SRX096066 | 79,161,120 | 69073478 | 38.2 | 51,797 | 42,019 |
| 7 | ECA | Eschscholzia californica | Root | SRX096037 | 62,704,080 | 53,746,798 | 37.3 | 42,167 | 31,085 |
| 8 | GFL | Glaucium flavum | Root | SRX096058 | 60,410,640 | 38,697,818 | 63.2 | 31,100 | 15,861 |
| 9 | HCA | Hydrastis canadensis | Rhizome | SRX096072 | 71,077,680 | 61,254,386 | 87.8 | 33,335 | 18,744 |
| 10 | JDI | Jeffersonia diphylla | Root | SRX202488 | 331915850 | 235,742,972 | 187.5 | 86,832 | 24,421 |
| 11 | MAQ | Mahonia aquifolium | Bark | SRX202767 | 231932044 | 196,915,558 | 62.2 | 98,375 | 13,866 |
| 12 | MCA | Menispermum canadense | Rhizome | SRX096076 | 82,491,120 | 71,509,392 | 42.7 | 87,141 | 32,954 |
| 13 | NDA | Nandina domestica | Root | SRX096070 | 84,144,000 | 70,453,764 | 51.9 | 70,425 | 27,337 |
| 14 | NSA | Nigella sativa | Root | SRX096077 | 76517332 | 70,223,386 | 56.3 | 67,591 | 22,508 |
| 15 | PBR | Papaver bracteatum | Stem | SRX096061 | 69721200 | 57,768,096 | 36.0 | 70,428 | 37,752 |
| 16 | SCA | Sanguinaria canadensis | Rhizome | SRX096071 | 71,713,920 | 59,322,808 | 23.3 | 53,019 | 37,241 |
| 17 | SDI | Stylophorum diphyllum | Stem | SRX096064 | 70,502,640 | 52,300,928 | 59.5 | 50,125 | 18,970 |
| 18 | TFL | Thalictrum flavum | Root | SRX096062 | 66,080,640 | 49,761,080 | 79.6 | 41,982 | 15,426 |
| 19 | TCO | Tinospora cordifolia | Callus | SRX202768 | 238,046,752 | 195,094,516 | 142.6 | 81,927 | 18,967 |
| 20 | XSI | Xanthoriza simplicissima | Rhizome | SRX245855 | 67,378,080 | 59,166,962 | 93.4 | 48,447 | 16,436 |
| | | Average | | | 116,506,219 | 94,443,056 | 69.6 | 63,886 | 24,442 |

TABLE 4

| No. | Abbrev. | Plant | Rocha GS-FLX Titanium | | | | | Illumina GA/HiSeq | | | | |
|---|---|---|---|---|---|---|---|---|---|---|---|---|
| | | | Unigenes | Overall annotated | High-level annotated | GO annotated | EC number allocated | Unigenes | Overall annotated | High-level annotated | GO annotated | EC number allocated |
| 1 | AME | *Argemone mexicana* | 25,499 | 22,121 | 17,979 | 21,974 | 3,086 | 75,101 | 60,836 | 45,404 | 60,254 | 7,653 |
| 2 | BTH | *Berberis thunbergii* | 41,672 | 33,548 | 23,243 | 33,080 | 4,197 | 68,302 | 61,576 | 41,927 | 60,561 | 7,289 |
| 3 | CMA | *Chelidonium majus* | 23,878 | 19,635 | 13,977 | 19,460 | 2,368 | 45,005 | 42,057 | 33,449 | 41,956 | 6,092 |
| 4 | CMU | *Cissampelos mucronata* | 35,166 | 27,451 | 19,865 | 27,139 | 3,147 | 69,622 | 32,209 | 22,943 | 31,597 | 3,314 |
| 5 | CTR | *Cocculus trilobus* | 34,783 | 26,678 | 18,701 | 28,338 | 3,197 | 84,793 | 33,055 | 21,961 | 30,542 | 432 |
| 6 | CCH | *Corydalis chelanthifolia* | 22,511 | 19,161 | 14,633 | 19,024 | 2,433 | 51,797 | 46,423 | 42,764 | 48,139 | 7,738 |
| 7 | ECA | *Eschscholzia californica* | 32,150 | 26,430 | 21,403 | 28,194 | 4,221 | 42,167 | 38,332 | 32,677 | 38,063 | 6,545 |
| 8 | GFL | *Glaucium flavum* | 26,520 | 20,945 | 15,645 | 20,725 | 2,719 | 31,100 | 31,100 | 19,669 | 31,100 | 3,231 |
| 9 | HCA | *Hydrastis canadensis* | 23,809 | 20,443 | 15,491 | 20,230 | 2,511 | 33,335 | 33,335 | 20,896 | 33,335 | 3,637 |
| 10 | JDI | *Jeffersonnia diphylla* | 36,773 | 24,583 | 16,777 | 24,199 | 2,581 | 86,832 | 31,712 | 22,574 | 30,842 | 3,116 |
| 11 | MAQ | *Mahonia aquifolium* | 36,429 | 30,209 | 20,624 | 29,805 | 3,581 | 98,375 | 53,093 | 33,434 | 47,040 | 621 |
| 12 | MCA | *Menispermum canadense* | 36,399 | 31,715 | 24,565 | 31,482 | 4,495 | 87,141 | 70,524 | 52,713 | 69,877 | 8,924 |
| 13 | NDA | *Nandina domestica* | 45,387 | 33,501 | 24,308 | 33,010 | 4,186 | 70,425 | 53,109 | 38,428 | 52,531 | 6,553 |
| 14 | NSA | *Nigella sativa* | 60,506 | 36,231 | 25,560 | 35,591 | 4,526 | 67,591 | 41,260 | 29,127 | 40,316 | 4,807 |
| 15 | PBR | *Papaver bracteatum* | 48,224 | 33,168 | 24,381 | 32,767 | 4,988 | 70,428 | 56,483 | 37,334 | 53,039 | 6,793 |
| 16 | SCA | *Sanguinaria canadensis* | 25,652 | 20,493 | 15,938 | 20,301 | 2,621 | 53,019 | 47,247 | 40,122 | 46,890 | 7,715 |
| 17 | SDI | *Stylophorum diphyllum* | 43,568 | 34,954 | 26,144 | 34,614 | 5,115 | 50,125 | 40,797 | 30,157 | 40,324 | 5,276 |
| 18 | TFL | *Thalictrum flavum* | 21,146 | 17,609 | 12,121 | 17,431 | 2,294 | 41,962 | 33,120 | 23,900 | 32,711 | 4,123 |
| 19 | TCO | *Tinospora cordifolia* | 34,518 | 28,044 | 21,199 | 27,795 | 3,444 | 81,927 | 35,851 | 24,174 | 34,712 | 3,386 |
| 20 | XSI | *Xanthoriza simplicissima* | 42,969 | 33,657 | 22,165 | 33,187 | 3,740 | 48,447 | 39,281 | 27,434 | 38,831 | 4,642 |
| | | Average | 34,368 | 27,128 | 19,736 | 28,817 | 3,472 | 63,886 | 44,169 | 32,055 | 43,133 | 5,089 |

TABLE 5

| Substrate | Enzyme | | | | | | |
|---|---|---|---|---|---|---|---|
| | GFLOMT1 | GFLOMT2 | GFLOMT3 | GFLOMT4 | GFLOMT5 | GFLOMT6 | GFLOMT7 |
| (R,S)-Norlaudanosoline | 96 | 100 | nd | nd | nd | nd | nd |
| (R,S)-6-O-Methylnorlaudanosoline | 87 | 1 | nd | nd | nd | nd | nd |
| (R,S)-6-O-Methyllaudanosoline | 68 | 14 | nd | nd | nd | 23 | nd |
| (R,S)-Norreticuline | nd | nd | nd | nd | nd | 36 | nd |
| (S)-Reticuline | 6 | 22 | nd | nd | nd | 97 | nd |
| (R,S)-Scoulerine | 32 | 75 | nd | nd | nd | 100 | 12 |
| (R,S)-Tetrahydrocolubamine | 19 | 32 | nd | nd | nd | 91 | 8 |

TABLE 6

| Compound | [M + H]+ or [M]+ | RT (min) | CE (eV) | ESI-CID spectrum m/z (relative intensity) | Reference |
|---|---|---|---|---|---|
| Norlaudanosoline [1] | 288 | 2.20 | 30 | 288 (1), 164 (60), 161 (14), 143 (40), 137 (5), 123 (100), 115 (25), 91 (5) | Authentic standard |
| 6-O-Methylnorlaudanosoline [2] | 302 | 2.64 | 30 | 207 (9), 179 (8), 178 (56), 175 (12), 163 (16), 160 (9), 143 (51), 137 (10), 123 (100), 115 (18) | Authentic standard |

TABLE 6-continued

| Compound | [M + H]+ or [M]+ | RT (min) | CE (eV) | ESI-CID spectrum m/z (relative intensity) | Reference |
|---|---|---|---|---|---|
| 6-O-Methyllaudanosoline [3] | 316 | 2.62 | 30 | 207 (9), 192 (52), 179 (8), 178 (6), 177 (19), 175 (16), 161 (5), 160 (10), 143 (48), 137 (17), 123 (100), 115 (15), 91 (5) | Authentic standard |
| Norreticuline [4] | 316 | 2.95 | 30 | 239 (5), 207 (9), 179 (8), 178 (100), 175 (11), 163 (30), 160 (10), 151 (6), 143 (48), 137 (72), 121 (8), 119 (5), 115 (19), 91 (5) | Authentic standard |
| Scoulerine [5] | 328 | 3.08 | 30 | 178 (100), 163 (19), 151 (10), 119 (5) | Authentic standard |
| Reticuline [6] | 330 | 2.98 | 30 | 207 (8), 192 (100), 179 (6), 177 (36), 175 (15), 160 (8), 151 (7), 143 (47), 137 (81), 115 (13) | Authentic standard |
| Norlaudanine [7] | 330 | 3.25 | 25 | 330 (2), 313 (2), 298 (2), 281 (6), 266 (2), 253 (5), 241 (2), 229 (2), 206 (2), 192 (100), 178 (57), 165 (3), 151 (22), 143 (5), 137 (28) | Desgagne-Penix and Facchini, 2012 |
| Tetrahydrocolumbine [8] | 342 | 3.32 | 30 | 178 (100), 163 (18), 151 (6) | Authentic standard |
| Codamine [9] | 344 | 3.15 | 25 | 344 (1), 253 (2), 192 (100), 175 (7), 151 (24), 143 (17), 137(2) | Desgagne-Penix and Facchini, 2012 |
| Laudanine [10] | 344 | 3.24 | 25 | 344 (3), 313 (7), 298 (3), 282 (3), 267 (1), 253 (4), 206 (100), 192 (23), 189 (51), 175 (5), 174 (10), 158 (1), 151 (22), 143 (1), 137 (52) | Schmidt et al, 2007 |
| Tetrahydropapaverine [11] | 344 | 3.42 | 30 | 296 (6), 281 (8), 192 (100), 189 (24), 177 (12), 176 (9), 174 (29), 165 (6), 159 (13), 158 (30), 151 (89), 148 (6), 144 (5) | Authentic standard |
| Tetrahydropalmatine [12] | 356 | 3.61 | 30 | 192 (100), 177 (6), 176 (5), 165 (15), 150 (9) | Authentic standard |
| Laudanosine [13] | 358 | 3.40 | 25 | 358 (3), 327 (3), 312 (1), 296 (4), 206 (100), 189 (34), 174 (10), 165 (8), 158 (5), 151 (29), 44 (1) | Schmidt et al, 2007 |

TABLE 7

| Recombinant Enzyme | Substrate | Product(s) | [M + H]+ or [M]+ | RT (min) | CE (eV) | ESI[+]-CID spectrum of product m/z (relative intensity) | Number of isoquinoline (I) or benzyl (B) methyl groups |
|---|---|---|---|---|---|---|---|
| GFLOMT1 | Norlaudanosoline | 6-O-Methyl-norlaudanosoline [2] | 302 | 2.62 | 30 | 207 (8), 179 (10), 178 (53), 175 (7), 164 (12), 163 (17), 160 (8), 143 (47), 137 (19), 123 (100), 115 (23) | I: 1 |
| | | Norreticuline [4] | 316 | 2.95 | 30 | 207 (6), 179 (5), 178 (100), 175 (9), 163 (28), 160 (6), 143 (50), 137 (73), 122 (67), 115 (16) | I: 1, B: 1 |
| | 6-O-Methyl-norlaudanosoline | Norreticuline [4] | 316 | 2.95 | 30 | 207 (7), 179 (5), 178 (100), 175 (7), 163 (30), 160 (7), 143 (46), 137 (78), 122 (7), 115 (21) | I: 1, B: 1 |
| | | Norcodamine [14] | 330 | 3.15 | 30 | 178 (100), 175 (9), 163 (26), 151 (53), 143 (45), 115 (9) | I: 1, B: 2 |
| | 6-O-Methyl-laudanosoline | Reliculine [6] | 330 | 2.99 | 30 | 207 (6), 192 (100), 177 (26), 175 (15), 160 (7), 151 (6), 143 (36), 137 (68), 115 (8) | I: 2, B: 1 |
| | | Codamine [9] | 344 | 3.17 | 30 | 192 (100), 177 (19), 175 (6), 151 (44), 143 (39) | I: 2, B: 2 |
| | Reticuline | Codamine [9] | 344 | 3.15 | 30 | 192 (100), 175 (10), 151 (45), 143 (33), 137 (6), 115 (5) | I: 2, B: 2 |
| | Scoulerine | Tetrahydro-palmatrubine [15] | 342 | 3.42 | 30 | 192 (100), 177 (5), 176 (7), 165 (18), 150 (10) | I: 2, B: 1 |
| | | Tetrohydro-palmaline [12] | 356 | 3.62 | 30 | 192 (100), 177 (6), 176 (6), 165 (18), 150 (8) | I: 2, B: 2 |
| | Tetrohydro-columbamine | Tetrahydro-palmatine [12] | 356 | 3.62 | 30 | 192 (100), 177 (6), 176 (6), 165 (18), 150 (8) | I: 2, B: 2 |
| GFLOMT2 | Norlaudanosoline | 6-O-Methyl-norlaudanosoline [2] | 302 | 2.64 | 30 | 207 (10), 179 (10), 178 (61), 175 (12), 163 (16), 160 (9), 143 (52), 137 (10), 123 (100), 115 (17) | I: 1 |

TABLE 7-continued

| Recombinant Enzyme | Substrate | Product(s) | [M + H]+ or [M]+ | RT (min) | CE (eV) | ESI[+]-CID spectrum of product m/z (relative intensity) | Number of isoquinoline (I) or benzyl (B) methyl groups |
|---|---|---|---|---|---|---|---|
| | 6-O-Methyl-norlaudanosoline | Nororientaline [16] | 316 | 2.88 | 30 | 239 (6), 224 (5), 207 (5), 178 (100), 175 (10), 163 (12), 160 (14), 143 (91), 137 (98), 115 (11) | I: 1, B: 1 |
| | 6-O-Methyl-laudanosoline | Orientaline [17] | 330 | 2.85 | 30 | 207 (8), 192 (100), 178 (6), 177 (25), 175 (19), 160 (7), 151 (9), 143 (60), 137 (93), 115 (9), 91 (5) | I: 2, B: 1 |
| | | Reticuline [6] | 330 | 2.98 | 30 | 192 (100), 177 (28), 175 (17), 160 (7), 151 (6), 143 (43), 137 (60), 115 (7) | I: 2, B: 1 |
| | | Codamine [9] | 344 | 3.15 | 30 | 192 (100), 177 (18), 175 (7), 151 (31), 143 (25) | I: 2, B: 2 |
| | Reliculine | Codamine [9] | 344 | 3.18 | 30 | 192 (100), 177 (17), 175 (9), 151 (39), 143 (29) | I: 2, B: 2 |
| | Scoulerine | Tetrahydro-palmatrubine [15] | 342 | 3.43 | 30 | 192 (100), 177 (6), 165 (26), 150 (11) | I: 2, B: 1 |
| | | Tetrahydro-palmatine [12] | 356 | 3.61 | 30 | 192 (100), 177 (9), 176 (13), 165 (31), 150 (11) | I: 2, B: 2 |
| | Tetrohydro-columbamine | Tetrohydro-palmatine [12] | 356 | 3.59 | 30 | 192 (100), 177 (5), 165 (15), 150 (7) | I: 2, B: 2 |
| GFLOMT6 | 6-O-Methyl-laudanosoline | 6,7-O,O-Dimethyl-laudanosoline [18] | 330 | 2.87 | 30 | 284 (7), 206 (40), 192 (16), 190 (9), 189 (30), 177 (10), 175 (6), 174 (17), 161 (9), 159 (5), 158 (19), 151 (11), 143 (17), 137 (26), 123 (100), 91 (6) | I: 3 |
| | Norreticuline | Norcodamine [14] | 330 | 3.16 | 30 | 178 (100), 163 (25), 151 (60), 143 (52), 115 (12) | I: 1, B: 2 |
| | | Norlaudanine [7] | 330 | 3.25 | 30 | 222 (9), 192 (100), 189 (11), 187 (13), 178 (13), 177 (16), 176 (10), 174 (13), 165 (8), 159 (16), 158 (10), 151 (8), 145 (11), 143 (20), 137 (91), 115 (5) | I: 2, B: 1 |
| | | Tetrahydro-papaverine [11] | 344 | 3.43 | 30 | 295 (5), 193 (6), 192 (100), 191 (82), 189 (10), 177 (15), 174 (36), 159 (14), 151 (77), 136 (11), 107 (10) | I: 2, B: 2 |
| | Reticuline | Codamine [9] | 344 | 3.17 | 30 | 192 (100), 177 (27), 175 (9), 160.3 (6), 151 (42), 143 (33), 115 (6) | I: 2, B: 2 |
| | | Laudanine [10] | 344 | 3.24 | 30 | 282 (6), 267 (5), 206 (98), 192 (8), 191 (15), 190 (11), 189 (29), 175 (6), 174 (24), 159 (6), 158 (21), 151 (28), 143 (7), 137 (100), 91 (5) | I: 3, B: 1 |
| | | Laudanosine [13] | 358 | 3.43 | 30 | 296 (6), 281 (5), 206 (100), 191 (9), 190 (9), 189 (31), 174 (23), 165 (11), 159 (5), 158 (18), 151 (68), 150 (5) | I: 3, B: 2 |
| | Scoulerine | Tetrahydro-columbine [8] | 342 | 3.29 | 30 | 178 (100), 163 (13), 151 (6) | I: 1, B: 2 |
| | | Tetrahydro-palmatine [12] | 356 | 3.59 | 30 | 192 (100), 177 (5), 165 (16), 150 (8) | I: 2, B: 2 |
| | Tetrahydro-columbamine | Tetrahydro-palmatine [12] | 356 | 3.6 | 30 | 192 (100), 177 (5), 165 (20), 150 (9) | I: 2, B: 2 |
| GFLOMT7 | Scoulerine | Tetrahydro-columbamine [8] | 342 | 3.33 | 30 | 178 (100), 163 (15), 151 (5) | I: 1, B: 2 |
| | | Tetrahydro-palmatrubine [15] | 342 | 3.44 | 30 | 192 (100), 190 (5), 177 (5), 165 (21), 150 (11) | I: 2, B: 1 |
| | Tetrohydro-columbamine | Tetrohydro-palmatine [12] | 356 | 3.62 | 30 | 192 (100), 165 (15), 150 (10) | I: 2, B: 2 |

REFERENCES

Caniard, A., Zerbe, P., Legrand, S., Cohade, A., Valot, N., Magnard, J.-L., Bohlmann, J., Legendre, L. 2012. Discovery and functional characterization of two diterpene synthases for sclareol biosynthesis in *salvia sclarea* (L.) and their relevance for perfume manufacture. BMC Plant Biology 12, 119.

Chevreux, B., Pfisterer, T., Drescher, B., Driesel, A. J., Müller, W. E., Wetter, T., Suhai, S. 2004. Using the miraEST assembler for reliable and automated mRNA transcript assembly and SNP detection in sequenced ESTs. Genome Resource 14, 1147-1159.

Chomczynski, P., Sacchi, N. 1987. Single-step method of RNA isolation by acid guanidinium thiocyanate-phenol-chloroform extraction. Analytical Biochemistry 162, 156-159.

Desgagne-Penix, I., Khan, M. F., Schriemer, D. C., Cram, D., Nowak, J., Facchini, P. J. 2010. Integration of deep transcriptome and proteome analyses reveals the components of alkaloid metabolism in opium poppy cell cultures. BMC Plant Biology 10, 252.

Fossati, E., Ekins, A., Narcross, L., Zhu, Y., Falgueyret, J. P., Beaudoin, G. A., Facchini, P. J., Martin, V. J. 2014. *Reconstitution of a 10-gene pathway for synthesis of the plant alkaloid dihydrosanguinarine in Saccharomyces cerevisiae*. Nature Communications 5, 3283.

Gaasterland, T., Sensen, C. W. 1996. MAGPIE: automated genome interpretation. Trends in Genetics 12, 76-78.

Hawkins, K. M., Smolke, C. D. 2008. Production of benzylisoquinoline alkaloids in *Saccharomyces cerevisiae*. Nature Chemical Biology 4, 564-573.

Huang, X., Madan, A. 1999. CAP3: A DNA sequence assembly program. Genome Research 9, 868-877.

Iseli, C., Jongeneel, C. V., Bucher, P. 1999. ESTScan: a program for detecting, evaluating, and reconstructing potential coding regions in EST sequences. Proceedings of the 7th International Conference on Intelligent Systems for Molecular Biology 7, 138-148.

Jurka, J., Kapitonov, V. V., Pavlicek, A., Klonowski, P., Kohany, O., Walichiewicz, J. 2005. Repbase Update, a database of eukaryotic repetitive elements. Cytogenetic and Genome Research 110, 462-467.

Langmead, B., Trapnell, C., Pop, M., Salzberg, S. L. 2009. Ultrafast and memory-efficient alignment of short DNA sequences to the human genome. Genome Biology 10, R25.

Li, B., Dewey, C. N. 2011. RSEM: accurate transcript quantification from RNA-Seq data with or without a reference genome. BMC Bioinformatics 12, 323.

Li, W., Godzik, A. 2006. Cd-hit: a fast program for clustering and comparing large sets of protein or nucleotide sequences. Bioinformatics 22, 1658-1659.

Liscombe, D. K., Ziegler, J., Schmidt, J., Ammer, C., Facchini, P. J. 2009. Targeted metabolite and transcript profiling for elucidating enzyme function: isolation of novel N-methyltransferases from three benzylisoquinoline alkaloid-producing species. Plant Journal 60, 729-743.

Lottaz, C., Iseli, C., Jongeneel, C. V., Bucher, P. 2003. Modeling sequencing errors by combining hidden Markov models. Bioinformatics 19, ii103-112.

Martin, V. J. J., Pitera, D. J., Withers, S. T., Newman, J. D., Keasling, J. D. 2003. Engineering a mevalonate pathway in *Escherichia coli* for production of terpenoids. Nature Biotechnology 21, 796-802.

Martin, J. A., Wang, Z. 2011. Next-generation transcriptome assembly. Nature Reviews Genetics 12, 671-682.

Metzker, M. L. 2010. Sequencing technologies—the next generation. Nature Reviews Genetics 11, 31-46.

Minami, H., Kim, J. S., Ikezawa, N., Takemura, T., Katayama, T., Kumagai, H., Sato, F. 2008. Microbial production of plant benzylisoquinoline alkaloids. Proceedings of the National Academy of Sciences of the United States of America 105, 7393-7398.

Nakagawa. A., Minami, H., Kim. J. S., Koyanagi, T., Katayama. T., Sato. F., Kumagai, H. 2011. A bacterial platform for fermentative production of plant alkaloids. Nature Communications 2, 326.

Nakamura, K., Oshima, T., Morimoto, T., Ikeda, S., Yoshikawa, H., Shiwa, Y., Ishikawa, S., Linak, M. C., Hirai, A., Takahashi, H., Altaf-Ul-Amin Md., Ogasawara, N., Kanaya, S. 2011. Sequence-specific error profile of Illumina sequencers. Nucleic acids research 39: e90.

Novák, V., Slavík, J. 1974. Further alkaloids from *Glaucium flavum* CR. Collection of Czechoslovak Chemical Communications 39, 3352-3356.

Ouyang, S., Buell, C. R. 2004. The TIGR Plant Repeat Databases: a collective resource for the identification of repetitive sequences in plants. Nucleic Acids Research 32, D360-363.

Pruesse, E., Quast, C., Knittel, K., Fuchs, B. M., Ludwig, W., Peplies, J., Glöckner, F. O. 2007. SILVA: a comprehensive online resource for quality checked and aligned ribosomal RNA sequence data compatible with ARB. Nucleic Acids Research 35, 7188-7196.

Pruitt, K. D., Tatusova, T., Maglott, D. R. 2007. NCBI reference sequences (RefSeq): acurated non-redundant sequence database of genomes, transcripts and proteins. Nucleic Acids Research 35, D61-65.

Ro, D. K., Paradise, E. M., Ouellet, M., Fisher, K. J., Newman, K. L., Ndungu, J. M., Ho, K. A., Eachus, R. A., Ham, T. S., Kirby, J., Chang, M. C., Withers, S. T., Shiba, Y., Sarpong, R., Keasling, J. D. 2006. Production of the antimalarial drug precursor artemisinic acid in engineered yeast. Nature 440, 940-943.

Zhang, Z., Schwartz, S., Wagner, L., Miller, W. 2000. A greedy algorithm for aligning DNA sequences. Journal of Computational Biology 7, 203-214.

Zerbe, P., Chiang, A., Yuen, M., Hamberger, B., Hamberger, B., Draper, J. A., Britton, R., Bohlmann, J. 2012. Bifunctional cis-abienol synthase from *Abies balsamea* discovered by transcriptome sequencing and its implications for diterpenoid fragrance production. Journal of Biological Chemistry 287, 12121-12131.

Zerbino, D. R., Birney, E. 2008. Velvet: algorithms for de novo short read assembly using de Bruijn graphs. Genome Research 18, 821-829.

Ziegler, J., Facchini, P. J. 2008. Alkaloid biosynthesis: metabolism and trafficking. Annual Review of Plant Biology 59, 735-769.

SEQUENCE LISTING (1749 sequences)

SEQ ID NO: 1 - DNA, 966 bp, Papaver somniferum
atggagagtaatggtgtacctatgatcactctcagttccggcattcggatgcctgctttaggtatgggaacagctgaaacaatggtaaaaggaacagaaagagagaaattggcgtttttgaaagcgatagaggtcggttacagacacttcgatacagctgctgcataccaaactgaagagtgtcttggtgaagctatagctgaagcacttcaacttggtctaataaaatctcgagatgaactcttcatcacttccaagctctggtgcgctgatgctcacgctgatcttgtcctccctgctcttcagaattctctgaggaatcttaaattggactatcttgatctatatttgatacaccatccggtaagcttgaagccagggaagtttgttaacgaaataccaaaggatcatatccttccaatggactacaaatctgtatgggcagccatggaagagtgtcagacccttggcttcactagggcaatcggggtctgtaatttctcatgcaaaaggcttcaagagttgatggaaacagccaacagccctccagttgtgaatcaagtggagatgagcccgactttacatcaaaaaaatctgagggaatattgcaaggccaataatatcatgatcaccgcacactcagttttgggagccgtaggtgccgcctggggcaccaatgcagttatgcattctaaggtgcttcaccagattgctgtggccagaggaaaatctgttgcccaggttagtatgagatgggtttaccagcaaggcgcgagtcttgtggtgaaaagtttcaatgaagcgaggatgaaggaaaaccttaagatatttgattgggaactaacggcagaagacatggaaaagatcagtgagattccacaatctagaacaagctctgctgctttcttgttatcaccgactggacctttcaaaactgaagaagagttctgggatgagaaggattga

SEQ ID NO: 2 - DNA, 978 bp, Agremone mexicana
atggaggaagttattggcttggaaactgtggttccaaaagtaaccctaagtagtagttcaggtgacaattccatgccagtaataggttttgggacagctgcatctccaatggctgatcatgaaattacgaaagctgctgttctcgttgggatcgaaaatggttatcgtcacttcgatactgccgctgcttatggaacggaaaaggctgttggtgaagccatagctgaagccctacgtctcggtttgatcaaatctcgagctgaagtttttattactactaaactttggtgtagaagttgcgaacgtgaccttgttgtcccctcactcaagaatagcctccaggatttacaaacggattacgtagatcttttcctcatacattggccagtgagactacgtcatgacgcaggacgacctcctatttcgagagaccaaatcctaacttttgatacaaaatcagtttgggaaggaatggaagaatgtcatgaattagggctcgcaaaaaatatcggagttagtaacttttctatcaagaagctcgaagaattactagccacggcaaagattcccccggtgctcgatcaagtggaactgagcccaacttggcaccagaagaatctgatcgagtattgtaaggaaaagggtattcatgtaacggcttattcagctttaggagccaataacacacattggggaaacaatcgagtcgtggagagtgatgtgttaggtgagatagctaaggctcggggaaaaactacagctcagatcgcattgagatgggtatatgagcaaggtgtgagtatggtggtcaagagttttaaccaagaaaggatgaaacaaaaccttcagatcttcgattttgagttaactgaagaagagtcaaataaaatcagtcaatttccacagcacaaaggagtaagcctgtctgcagtttatggtgatcatgatatactcaaggagatggaagctgaactttga

SEQ ID NO: 3 - DNA, 969 bp, Agremone mexicana
atggagaatgtaattcctagagtgacattgagctctggaagtgtgatgcctatattaggtatgggtacagcatcatacccatttgttagttcagaagaagggaaattggcaatactgaatgcaatcaaagtaggttatagacactttgatacagcttctacttacatgtttgaggagtttcttggtgaagctatagctgaagcaattcaacttggactgatcaaatcccgtaaagaactgttcattacttccaaattatggtgctgcgatgctcatcctgatcttgtcgttccttctcttcgaaactcattacggaatcttaagttggagtaccttgatttatatctgatacactttccagtaagcttgaaggcagggaggtatgagtatccacccctaaaggaagctttagttctgatggattacaagtctgtatgggcagccatggaagagtgccaaaatcttggccttaccaagtcaattggtgtaagcaacttctcttgcaagaagcttcaaactattttggactatgccaaaatccctccctcagttaatcaagtggagatgaatccagtttggcaacagaagaaactgagagaattttgcaaggccaacgatattgttatcactgcttactcacctttaggagctagtggaaccccgtggggatcgagcagagtacttgatgcacaagttctgcatgaaattgctagggctaaagggaaaactcatgctcaggtttgtttgagatgggtatacgaacaaggagtgagtttgcttgtaaagaccttcaatgaagagaggatgaaggaaaacctaaggatatttgactgggaactgactgaagaagataagcaaaagatcagtaaaataccacagcatagaggactgactggtgatgcttttgtctcagaacatgaaggggcacccttcaagactgcagaagagttatgggatggagaagtttga

SEQ ID NO: 4 - DNA, 969 bp, Agremone mexicana
atggatatgaataaacatgcggttgtttatgttccaacaaaagtcatcatggggattccagtgattggctttggtacatcagctgatccccctgtcgactttgatacgactaggctggcaattatgcaagctattgaaaatggttacaggcattttgatacagctgctctttataactcggaacagcctcttggtgaagctattaacgaagccattagtcgtggattgattaaatctcgagatgaacttttcatcacttccaaattatggtgcagcgatacccatccacaacatattcttcctgccatacaaaagactctcagaaatctgaatatggagtatcttgatctgtatcttatccactggccagtgagttcgaggcacgaaaattttgaatatccgataaagaaagaagattttcttcctatggattttaagaaagtgtgggccgcaatggaagaatgtcataaacaggggctcgcaaagtttattggagtcagcaatttctcttgcaagaaacttgacaatatcatggcctctgcaacaatttccccttcagttcttcaagtggaagtaaatccatgttggcaacaaaaaaggttgatagatttttgcaaagctaatggaatatttgtagttgcttatgctcctttaggagcagtggggacaatttatggaactaatagagttatggaatctgatgttctcaagcaaattgccaagaaaagaggaaaaagtgttgcacaggtttgtttgagatgggcatatgagcaaggcattggtgtggtggtgaaaagctttaacaaggagaggatgaagcagaaccttgaaatattcgattggaaactgagtgaagaggatacgaagaaaattagtgaaattcaacaagatcgagcttgtcttggaatggattatacatcaccatatggaccttacaagacaataaaacaactatgggatgaagagtaa

SEQ ID NO: 5 - DNA, 969 bp, Berberis thunbergii
atggaaattgttcctaaagtgacattgaattctggctatcaaatgcctcttttaggcttcggaacagccgaaaattggccgtttaccaaatctgaagcagccaaacgggcaatactgtgtgcaatcaagaatggctacagacactttgacacagcttccatgtaccaatcagaggagtcacttggtgaagctatagtcgaagcgcttcaccttggccttatcaaatctcggaatgaactcttcatcacttccaagctatggtgtagtgattgtcaccaagatcgcgttctccctgcccttagggagactctcaagaatcttcacttggattaccttgatctttacctcatacattggccgctaagcgcaaagccagggaagcatgagtacccaatactaaaagataagcttcttcctatggactatgaatccgtatggggagcaatggaagaatgccagaggcttggcctctctaagtccattggagtcagcaacttctctagcaagaagctggaacagctactcaaaactgcaaagattattcctgcagttaatgaagtggaagtgaaccctgtttggcatcaaaataagctaatagagttctgtaaggccaaaggtattgttgtgactggttactctcctttaggtgccaaaggaacaacttggggaaccaataaagtcatggacagtgaggtcctgaaagagattgctaagactagaggaaagacacatgctcaggtttgtctgagatggatatacgagcaaggagttggcctggtggcgaagagctttaatgaagagaggatgaaggagaatttggagatatttgattgggcattgactgaagaagagtccaaacagatcagccagttaccacaatataaagggcaaaatggagaaacgtttctctcagctgaagggcctttcaagaccttagaggagctatgggatgaagaggtagcagcttga

SEQ ID NO: 6 - DNA, 963 bp, Berberis thunbergii
atggaaattgttcctaaagtgacattgaattctggctatcaaatgcctcttttaggcttcggaacagccgaaaattggccgtttaccaaatctgaagcagccaaacgggcaatactgtgtgcaatcaagaatggctacagacactttgacacagcttccatgtaccaatcagaggagtcacttggtgaagctatagtcgaagcgcttcaccttggccttatcaaatctcggaatgaactcttcatcacttccaagctatggtgtagtgattgtcaccaagatcgcgttctccctgcccttaagaacacactccagaatcttcaactggattaccttgatctttaccttattcattttccgctgagttcaaagcgaggtaaacttgagtatccactacaggaagacgagacctatcccatggatttcggatctgtatgggaagagatggaaaagtgccaaagggttggtctcaccaaatccattggagtcagcaatttctctgctaagaagattgaacacctactcacgaccgcaaagattatccccgccgttgatcaagttgagatgaatccattgtggcaacaaaggactctgagagagtattgtaagaccaaaggtatcgttgtgacagcttactcacctttaggtgccaaaggtgcaatttggggatccaatatcgttatggagaatgaggtgctagcagagattgctaaggctaaaggaaagacccatgctcaggtatgtctgagatcagtgtacgaaaaaggcgttgcattggtaacgagaagctacaatgaagaaaggatgaagcagaatctaaacatatttgattggaacttgagcaaagaagagaccaaacgtatcgacaacttgccacaaaaaagagtcttccttggagaaggatttctgtctcccctaggacccttcaagtctccagaggaactatgggatggagagatgtga

SEQ ID NO: 7 - DNA, 975 bp, Corydalis chelanthifolia
atgatggtgagtgttcctgaggtgacactgcagagtagttccagtgataaaaagatgcctattatgggcatgggcactgcagcctatcctttcgccgaatcagatgaagcaaaggctgcactcttaacttcaatcaagcttggttacagacattttgatacagcttcactgtaccacaatgagaagtctgtaggtaaagctatatctgaggctcttaaactcggactcgtcaaatctcgagatgaattctacatcaactccaagctatggtgctctgattctcacccagaccgagtcatccctgcccttcaagagtcactcaagaagcttgggttggagtaccttgatatgtatcttattcattggccattgagcttgaagaaagggagttatgagttccctataccaacggacgaggaaatactacctatggacttcaaggcagtatgggcagccatggaggagtgccaaaagcttggcctcactaagtccattggtgtcagcaacttttcttgtaagaagcttgaaacaattctctctacggccaagatacctcctgttgttaatcaggtggagttgaacacactttggcaacagacgaaactaaacaaattttgtaaggacaatggtatcgttcttatggcattttcccctttgggagctcacggaagtccttggggaacaaaccgtgttatggaatgcgagttacttcatgagattgcaaaggcaaaaggaaagactcttgctcaggtttgtctgagatggatatatgagcaaggtgctggtatattagtaaagagctacaatgaagtgcggatgaaggaaaacctggagatattcgattgggaattgagtgcagaagagttgaaaagtatcagtgaacttccacagcatagaggcttcccagctgattctctcctctcagctaaagggccatttagaactgaagaagagctctgggatggagagatctga

SEQ ID NO: 8 - DNA, 1020 bp, Corydalis chelanthifolia
atggagagtgttgcttgtgagcctggagtaatcgagcagcagcagtactttattcccgaggtgacctgcggtggaggcagcagcaccaccaggatgaggatgcctgttgtaggcatgggtacagcctcgtacccgtttgctggatcagaaggtgtaaagcaagctctcttacatgcaatcaagcttggttactggcattttgatacagcttctttttaccagaccgagcaatctctgggtgaagctatctctgaggcaatccaacttgggctgatcaaatctagagatgaactcttcatcacttctaagctgtggtgcactgatgcacacaaagatcttgtcctccctgcccttcaaaacaccctcaggaatcttcaattggagtaccttgacctttaccttatacattttccgataagcttgaagccagggagatatgatttccctgtacaatcaaaggaggacctccttccaatggactttaaatctatatgggcaaaaatggaagagtgtcagggacttgggctcactaaatccattggtgtcagcaatttttcatgcaagaaacttgaaaatttacttgccacagccaagattcctcctgctgttaatcaggtagagatgaatccactttggcaacaaaagaaactaagggagttctgtaaagctaatggtatcactattacggcccactcccctttaggagccaaaggaactaattggggaaccaaccgtgtagtagaatgtgaagtgttgcaccagattgccaaggctaaaggaaaatctcatgctcaggtttgtttgagatgggtatatgagcaaggagtgagtctgttggtgaagagcttcaacaaagaaaggatgaaagagaacctggggatatttgactgggaattgaatgctgaagatttaaagaagatcagtgagattccacagggtagaggactacctgttgatggttttctttcaccaaatggtcctttcaagtctgaagaagaattttgggatggagagatttga

SEQ ID NO: 9 - DNA, 906 bp, Corydalis chelanthifolia
atgcctgtagtaggctttggcacggctaaatttccctttggtgatgatgaagcgattaaattggcagttcttgaaggaatcaagcttggttacagacacttcgacactgctactaaatataaatcagagaagcctctcggtgaaaccattgttgaagctattaaccttggtttaatcaaatctcgtgatgaattattcatcacgtccaaattatggtgtggaagcactgagcgcagcctcatcgtaccttcactcaagacgagtttacagaatctccaattggactacctagatctttatctcatacattggcccctgaggtttagcaccgacgaaactccaacaccagtcccaaaggaacaacttcttccctttgacaccaagtcagtttggcaagcaatggaagaatgccaaaatctcgggctcacgaaatcgattggtgtgagtaatttctcatgcaaaaaacttgaagaattactatccactgcgaagatcactccggcagttaatcaagtggagttgaacacatcttggcaacagacgaagatgagagagttctgtaaaggaaaaggtatacatataactggttattcacctctaggttcctatggaacaaaatggggagacaacagagttgttgagaatcaagtgttggaggagattggcaagcctagaggaaaaactgctgttcaggtttgcttgagatggatatatgagcagggagcaagtatggttgtcaaaagctttaacaaagagaggatgaaggctaaccttgacatttttgattggaagttaactgaggaagagttgaagaggatcagtcagcttccacagcataaagcatccctacctactgcctcctttggcgaccatgatgaagttagggagcttgactatgagatctga

SEQ ID NO: 10 - DNA, 984 bp, Chelidonium majus
atggagagtgatagtgcagcagcagcagtagtagttccagtaacgactctgagctcaggcattgagatgccgatgttaggtatgggaactgttgaaaactttcttccaggttccgaaacagtgaagttggctcttctgaatgcaataaaattagggtacaggcacttcgacacagctgctatataccaaactgaggagtgtcttggtgaagctgtagctgaagcacttcaacttggtctgatcaaatctagagaccaactcttcatcacttccaagctttggtgttctgacgctcatcctgatcttgtcatccctgctcttcagaactctctcaggaagctgaagttggagtatcttgatttatatctggtacattggccgttaagctcaaagccagggaactgtgtttttccaatactcaaggaggacctccttcctttggacttcaagtctgtgtgggcagccatggaagaatgtcaaaagcttggcctcacaaagtcaattggtgttagcaacttctcttgtaagaagcttcaagatttattgacttcggctatcatccctcccgttgttaatcaagtggagatgaacccacgttggcaacaaaagaaactgagagagttttgtaaggccagagatattgtggttaccgcctactcgcctctgggagccaaaggcaccgtgtatggatccggtgcagttatggactgcgaggtgttgcaccagattgccaagattagagggaagtctgttgctcaggtttctctaagatgggtataccagcaaggtgtgacaccgttagtgaagagtttcaatgaagaaaggatgaaggagaacatgaagatattcgattgggaattgtacgaagaagacttaaaaatgatcgacgagatcccacaaagtagagtcaacccttgttattttttcctctcagaaaacggacccttcaagactgtagaagaattctgggatggagaagtctaa

SEQ ID NO: 11 - DNA, 984 bp, Chelidonium majus
atggagagtagtaataatgcagtattagttccagtaataactctgaactcaggcagggagatgccaattgttggtatgggaacagctgaaaacctttttcaaggttcagaaagagtgaagttggctcttttgactgcaataaaggtgggttatagacactttgatacagctgctgtttaccagactgaggagtctcttggtgaagctatagctgaagcacttcaacttggactgatcaaatctagagatgaactcttcatcacttccaagctgtggttgcctgattgtcaccatgatcttgtcctccctgctcttcagaattctctcaggaagcttaagttggagtaccttgacctatatttgatacattggccggtaagctcgaagccaggagagatcaagcatgttataccaaaggaagagctcctcccaatggatttcaagtctgtgtgggcagccatggaagaatgtcacaagcttggcctcgccaagtcaattggagtcagcaacttctcttgcaagaagcttcaagatttattagtcactgccaacatccctcctgatgttaaccaagtggagatgaacccactttggcagcagacgaaactgagggaattttgtaaggctcacggcatcctcgttgcagcttactcgcctttaggagccaaaggcactgcatggggaagaaccaacggagttatggactctgaggtgctacaacagattgccaaggctagaggaaagtctattgcgcaggtttctctacgatgggtatatgaacaaggggtggttttgttggtgaagagtttcaacgaggaaaggatgaaggaaaacctgaagatattcgattgggaattaagtggagaagacttgaaaaagatcagcgagatcctcccacagcgtagaggactccctagtcatgtttttgtctccgatgacgggccattcaagtctgaggaagaactctgggatggagaagtgtga

SEQ ID NO: 12 - DNA, 984 bp, Chelidonium majus
atggagagtagtaataatgcagtattagttccagtaataactctgaactcaggcagggagatgccaattgttggtatgggaacagctgaaaacctttttcaaggttcagaaagagtgaagttggctcttttgactgcaataaaggtgggttatagacactttgatacagctgctgtttaccagactgaggagtctcttggtgaagctatagctgaagcacttcaacttggactgatcaaatccagagatgaactcttcgtcacttccaagttgtggattcctgattgtcaccatgatcttgtcctccctgctcttcaaaattctctcaggaagcttaagttggagtaccttgacctctatttgatacattggccagtaagctctaagccaggggagctcaggtcacttataccaaaggaggagctccttccaatggatttcaagtctgtgtgggtggccatggaagaatgtcacaagcttggcctcacaaagtcaattggtgttagcaacttctcttgcaagaagcttcgagatttattgctcactgccaacatccctcctgctgttaaccaagtggagatgaacccgctttggcaacagaagaaactgagggagttttgtaaggccaacggtatcgtcattgcagcttactcgcctttaggagccaaaggcactgcatggggaagaaccaacgacggagttatggactctgagttgctacaaaagattgccaaggctagaggaaagtctacggcgcaggtttctctacgatggggatatgaacaaggggtgattttgttggtgaagagtttcaatgaagagaggatgaaggaaaacctgaagacattcgattgggaattaagtggagaagacttgaaacagatcaacgagatcctcccacagcgtagaggacatagccatgaatttatctcagataacgggccattcaagtctgaggaagagctatgggatggagaagtgtga

SEQ ID NO: 13 - DNA, 987 bp, Chelidonium majus
atgggtgaggaaatgatcaagacgagtagtgttgaaattccagtagcgactctaagcactgggaggacgatgccgttgttaggtatggggacagcagcatacccatttgtggggtcagatggagtggtgaaagcgattctgcacgcgattaagctagggtacaggcactttgatacagctgctctatactttacagaggaatgtcttggtgatgctgtagctgaagcacttcgccttggattgatcaaatctcgagatgaactcttcatcacctcaaagttatattgctgtgatgctcatcctgatcgcgtcgtccctgctcttcagaactctctcaggaagctgaaaatggagtaccttgatctatatttgatacattggccggcaagcacacacgaagggaacttcgaatttcctttacaaaagcaggatatccttcctttggatttcaagtctgtgtgggcagctatggaagaatgtcaaaagcttggcctcaccaagtcaattggtgtcagcaacttctcttgcaagaaacttcaagatttactagcctcggctaagatccctcccgctgttaatcaagtggagatgaacccaatttggcaacagaataaattgagggaattctgcaaggcaaatgatatccacattacagcgtactcgcctttgggggccaatggaactccttggggctctagtggagttgccgaaactcaagtgctgcacgacattgctaaggctagagggaagactcatgctcaggtttgtttgcgatgggtatatgagcaaggtgtgagtgtgttggttaagagttacaatgaagagaggatgaaggagaatctggctgtattggattgggaattgagcgaagagaacttgaagaagattagtgaaatcccacaacgtagaggacttcctggtgatatcttcgtctcagataacgggcctttcaaaactgtagaagagctctgggatggagaagtatga

SEQ ID NO: 14 - DNA, 921 bp, Cocculus trilobus
atgccagtggtggggatggggttggcagcctatccatttcaagaatcagaggtagtgaagttggcaatgctaagggccattgagatgggttacaggcatttcgacacggctgcgctgtaccagacagagcagtcacttggtctagccattgcagaagcgcttgagcttggcttgatcaagtcccgtgatgagctcttcatcacttccaagctctggtgcagtgatgctcatcctcaccttgtcattcctgctcttcaaaggactctcaagaatcttgggttggactatgttgatctctatctcatacactggccagtgagctcaaacaaaccaggaaagtatgattttccagtaccaaaggaagaactagttcaaatggattatgaatctgtatgggcagccatggaagagggacataggcttggcctcacaaagtccattggtgtaagcaacttttcttgtaagaagcttgagaatttactcacaatagcaaaggtccctcctactgtcaatcaagtggagatgaaccccttttggcgacaatataaactgaaagagttctgcaaggaaaagggaattattatcactgcttactcaccattgggagccaaaggaactatttggggcaccaacaaagttatggaatctaaagtgcttgaagacattggaattgctagtggaaagactcttgctcaggtctgtctgagatgggtgtatgagcaaggagtgactcttttggtaaaaagcttcaatgaggagaggatgaaggggaacctagacatatttgattgggaattaagtgagaaagagctgaaaaagatcaatgagattccacagagcagaggactccctggtgacatctttgtgtcagatgatggacccttcaagtctgaagcagagctctgggatggagaagtttga

SEQ ID NO: 15 - DNA, 966 bp, Eschscholzia californica
atggggagttgtagtataccagtgaagagtctgagctcaggaagggagatgcctgtaataggtatgggaactgctgacagcaatctagcaggctctgatgcttcaaggatagcactagtgaaagctatagaggttggttatagacactttgatacagcttcaatttaccagagtgagcaaaaccttggagatgccattgctcaagcacttgaacttggtctcatcaaatctagagatgaactattcattacttccaagctatggtcttcagattctcaccccgatcgtgtcgtccctgctcttcaagaatccctcaggaagcttaaattggagtatcttgatctatatctaatacattggccggcaagttcgacaccagggatttatgagttccctataccaaaagatgagatctttccattggagtatgagactatttgggcagccatggaagaatgtcagaggcttgggcttacaaaatctattggtgttagcaacttttcttccaagaagctccaaactatattgaacaccgccaccatccctccggctgccaatcaagtggagatgaacccagtttggcaacagaagaaattgaaagagttttgtgacgccaacaatatcctgcttactgcatattcgcctttgggtgctaaaggaacctcgtggggaagcaataaagttatggagtctgaggttctgaaacaaattgctatggcgaacgggaagtctgttgctcaggttagtctgagatggttataccaaataggtgcaactatggtagtgaaaagttacaatgcagaaaggatgaaggagaacctgaagatattcgattgggagttgagtgatgaagacatgaaagcaatcagcgagattcctcagcgtcgaaattttgctggtgatattctgatttcaagtaacgggcccttcaaatccgaagacgaactctgggatggagaagtatga

SEQ ID NO: 16 - DNA, 972 bp, Eschscholzia californica
atgagtagttatggtagtgtaccaatgaagtcactaaactcaggaagtaaaattcatgttttagggtttggaacagctgcttacccatttgtgggatcagatggtgtgaagaatgccattcttaatgctataaagttaggttataggcattttgacacagctgctctctacttcactgaggagtctcttggtgaagctgtttctgaagcacttcaacttggtctcatcaaatctagagatgaactcttcatcacttccaagctttggatttctgatgcttatcctgatcgtgtcctccccgccattcaaaaaacacttcggaaccttaaaatggagtaccttgatctatacctgatacactggcccattagtgggaaagaggggaattttgatcttcctgtacctaaagattgtctccaggaattggactacaagccagtgtgggcagccatggaagaatgtcaaaagcttggactcactaaatccattggtgttagcaatttctcttgtaagaaacttcaaatcattctctcctcagctaccatccctcctgctgttaatcaggtggagatgaacccaatttggcaccagaagaagttgagagaattttgtaaggccaataatatcatgattgctgcttattcgccgttaggagctgctgggaccccatggggatcctccggtgtcgtcgagaccgaagtgctacacgagatagccagaagtagaggcaaaactcatgctcaggtttgtttgagatgggtatatgagcaaggggtgattgtgttggtgaagagctttaatgaagagaggatgaaggaaaacctatctgtgtttgactgggagttgacggacgaagacttgaagaaaatcagtcaaattcctcaacgtagaggacttcctagtggtgatatttgggtctcgacagaaggacctttcagatctgaagaagagctttgggatggagaaatctaa

SEQ ID NO: 17 - DNA, 975 bp, Glaucium flavum
atggagatgagtagtgcacaagtagttccactaatgactctaaactcaggcaaggagatacctgtattgggcatgggtactgctgaaaaccatttccaagggtctgatggaacaaaagatgcacttgttaatgcaataaaaattggttacagacactttgacacagctgctatatataacgttgaggagtgtcttggtgatgctatagctgaagcacttcaacatggtctcatcaaatcccgtgacgaacttttcatcacttcaaagctatggatatctgattcccaccctgaccgtgtcctctttgctcttcaaaattctctccggaagcttaagttggagtaccttgatctatatctgatacattggccgttaagctcaacgccagggaaatcggtgtttccggtacccaaggaggacttcctacctttggacttcaaatctgtgtgggcagccatggaagaatgccaaaaacttggcctcaccaagtcaattggtgtcagcaacttctcttgcaagaagctccaagatttattggacattgccaacatccctcctgcagttaatcaagtggagatgagcccactttggcaacagaagaaacttagggagttttgtaaggtcaatggtatacttgttacagcttactcgcctttaggagccaaaggcaccttctggggctctaatgaaattatggactctcatgtgttacaagagattgctaaggctagagggaagtctgttgctcaggttactctcagatgggtatatgagcaaggagtgattttgttggtgaagagttttaatgaaaatagaatgaaggagaatatggcgatatttgattgggatttgagcatcgacgacttgaaaaaattcgatgagatctcacagcgcagaggaaaccttggcgatttttttgtttcagaaaacgggcccttcaagtctgtagacatggtttgggatggagaggtctaa

SEQ ID NO: 18 - DNA, 981 bp, Glaucium flavum
atggagagtagtagtagtagtgcagtagtagttccagtaatgactctgaactcaggcaaggagatgcctgtattaggtatgggaactgctgaaaacaatcttcaagggtctgagaaaacaaaattggctcttttgactgctataaaagccggttacagacactttgacacagcttctgcatacaatactgaggaggcactaggtgaggctgtggctgaagcacttcaacttggtctcattaaatctcgagacgaactcttcatcacttccaagctatggtgctctgatgctcaccctggacttgttgtccctgctcttcaaaattcactacggaatctaaagttggagtatcttgatctatatctgatacattggccagtaagtttaaagccgggaaaattcgtgattcctttttccaaggaggacatccttcctttggacttcaaaaatgtctgggcagctatggaagaatgtcaaaagcttggccttgccaagtcaattggtgtcagcaacttctcttgcaagaaactccaagacttattggcaattgccaacatccctcctgctgttaatcaagtggagatgagcccactttggcaacagaagaaactgagggagttttgtaaggtcaatggtatacttgttacagcttactcgcctttaggagccaaaggcaccttctggggctctaatgaaattatggactctgatgtgctaaaccaaattgctaaggctagaggaaagtctgttgctcaggtttctctcagatgggtacacgagcaaggggtgattttgttagtgaagagttttaatgaaaatagaatgaaggagaatatggccatatttgactgggaattgagcaacgacgacttgaaaaagatggatgagatctcacagcgtagaggaccccttgctgatatttttgtttcagaaaacgggcccttcaagtctgtagacatgctttgggatggagggttctga

SEQ ID NO: 19 - DNA, 981 bp, Glaucium flavum
atggggagtagtgatgcagtagtagttccagtaaagactttgagctcggggaggaagatgcctgtaataggcatgggaactgctgaaatccttcttgtggacgggtccgaaaaagtgaagttggctcttctaaatgctattaaaattggttacagacactttgatacagctgctgtgtaccgaactgaagaggctttgggtgaggttgtggctgaagcaattcaacttggtctcatcaaatctagagacgaactattcatcacttcaaagttatggttatctgattctcaccctgatcttgttctccctgctcttcagaactctctaaggaagcttaagttcgagtatcttgacctatatttgatacattggccattaagctcaaagccaggggagctgaaggttcttataccgaaggaggaactccttcctttggacttcaaatctgtgtgggcagccatggaagaatgtcaaaaacttggtctgacaaagtcaattggagtcagcaacttctcttgcaagaagcttcaagatttattggacattgccaacatcccacccgcggttaaccaagtggagatgaacccactttggcaacagaaaaaattgaatgagttttgtaaagccaatgatatcgtcattacagcttactcgcctttgggagccaaaggcaccccttggggatccaatagagttatggactctgaggtattaaaccagattgccaaggctagaggaaagtctgttgcacaggttgctcttagatgggtatatgaacaaggtgtgagtctagtggtaaaaagttttaacgaagagcggatgaaggaaaacgtgacgaagatatttgattgggaattaagcgcagaagacttgaaaaagatcgaggaaatcccacaatgtagaggagtccctagccatgtttttgtctcagttaacgggcctttcaaatctgaagaagagctgtgggatggtgaaatctaa

SEQ ID NO: 20 - DNA, 984 bp, Glaucium flavum
atgggtgaggaaatgaagatcaagagtgttgaaattccagtagtgacactaagctctggaaggaccatgcctgtgtttggtatgggtaccgcagcattcccatttgtagggtcagatggagtggtgaaagccattactcatgctataaagcttgggtataggcactttgatacggctgcactctacttcactgaggagtctcttggtgatgctatagctgaagcacttcgacttggactgatcaaatctcgagatgaactattcatcacttctaagctatggtgctgtgatgctcatcctgatcgtgtcctccctgctctgcgcaactctttgaggaatctgaaaatagagtatctagatctatacttgatacattggccggcaagcacacacgaagggaacttggaatttccaatacaaaagcaggacatccatcctttggattacaattctgtatgggcagccatggaggagtgtcaaacgcttggcctcaccaagtcaattggagtcagcaacttctcttgcaagaagcttcaacatatattagccattgccaagatccctcctgctgttaatcaagtggagatgaacccaatttggcaacagaagaaattaagagaattctgcaaggccaatgatatccatattacagcttactcgcctttaggagctaatgggaccccttgggggtctagtggagttgttgagactcaagtactacatgacattgctaaggctagagggaagactcatgctcaggtttgtctaagatgggtatacgagcaaggggtgattgtattggtgaagagctacaatgaagaaaggatgaaagagaatctgactgtattcgattgggaattgagcgcagaggactcgatgaagatcagtgagatcccacagcatagaggacttcctggtgatattttcgtttcagacagtgggcctttcaagtctgaagaggagctttgggatggagaagtctga

SEQ ID NO: 21 - DNA, 960 bp, Hydrastis canadensis
atgggtagtgttcctaatgtaattcttagctctggtcatccaatgcctcttgttggctttggcactgcgggttttccatttggaacatcagaaggtataaagtcagcaatactctgtgggatcaagaatggttacagacacttcgatacggcttccgtgtaccaaacagaacagatacttggtgaagctatagctgaagcacttgagctaggcctcattaaatctagagatgaactctttttaacctccaagctatggtgcagtgatgctcatcaacaacatgttctccctgcccttcagaagactctaaggactcttcagctggattatcttgatctttatctagtacactggccactgagctcaaaaccagggaagtatgagtacccaataccaaaggaagagcttcttcccatggatttcaaatctgtctgggctgcaatggaagagtgccaggctcttggcctcacaaagtccattggggtcagcaatttctcttgtaagaaacttgaacaattactctccacttcaaacatccctcctgctgtcaatcaagtggaggtcaacccaatttggcaacaaaataagctgagagagttttgtaaggccaaaggtataattgttgctgctttttctcctttgggtgctaaaggaacatcttggggaactaataaagttatggattctgaggtgctgaatgagattgcccaggctagaggaaagactactgctcagaattgtcttagatggttacatgagcaaggtgtgtgtgtggtggtgaagagcttcaatgaggagaggatgaaggggaacctgaaattatttgattgggaattgagtaaggaagagtctaagaagatcagccagttaccgcagagtaaaggacataccggagatgacatggtctcggccaatgggccatttaagtctttagaggagctatgggatggagagatttga

SEQ ID NO: 22 - DNA, 960 bp, Hydrastis canadensis
atgacaagaattccagagattgtgttgaactcaggatggaggatgccagttttggggatgggaacagcaacctttcctatccaatccccagaagtcattgagtcttccattgttaacgccatcgaattgggttatcgacacttcgacacagctagtgtatatcagtctgagtcacctctaggccgtgccatatcagaagctatacgtcgaggcctcattgagagtcgaaaagaggtcttcatcacctcgaagctatggtgcactgatgcacaccatgaccttgttatcccagctctccacaaaactctccagaatctggggttggagtacttggacttgtacctgattcatttcccagtgagactgaaaggagacatatcctttgacattaagaaggcagaccttataccctttgatgtaaagggtacatgggaggccatggagaagtgtcaagagctgggacttaccagatctattggtgttagcaacttttcatctaagaagctttccgagcttttaacccatgctaccatttctcccgctgtgaatcaggtggaaatgcacccattttggcaacagaaggaattgagagctttctgtgcagacaaaggtatacatgtaagtgcttattctcctttgggaggaaagggtgctttatggggctccgacatattactcaactccaaagagatcgaacggatcgctcaagctaaaggaaagagcatcgcgcaggtatgcttgagatgggcatatgaacaaggggtgagttacttaccaaaaagctacaataagggaaggatgaaagagaacatggaaatttttgactggcaattgagtgaagatgagttacaaaagatcagtcacctgccacaaggaaagatatacacaggacatcattttatatcagatgatggggaatataaatctcctattgatttatgggattgtgagatatgttag

SEQ ID NO: 23 - DNA, 963 bp, Hydrastis canadensis
atgggtatagttcgtgaggtagtgttgaattctggggaaagaatgccattgctaggaatgggaacagcaacatacccagttgctccatttgaactagttgagtcttcagtaattgctgccattgaacttggttataggcattttgacacagcaagtgtgtatgagacagagcaacctctaggcctagccatatctgaagccgtccggcaaggccttatcgctagtcgtgatgaaatcttcataaccactaagctttggtgtggtcatgcacattatgatcttgttctaccagctcttcgggactcactagaaacgatggggttggattatgttgatctgtacttgattcattttcctgcaagattcaacatgaaagagaagagcttaaatgtgaataagaaagatcttcttcctttggatataagagggacatggaaagctatggaggaatgttatgaacttggcttagcaaagtcaattggtgtcagcaacttcagttgcaaaaagctatctcaacttttgtctgttgctaacattccgcctgcagtgaatcaggtggagatgcatcctctttggcaacaacagaagttgagagagttttgtgaagaaaaaggtatacatgtgagtgcttattctcctttaggaggaaaagggaccatatggggctccaacgcagttttggactcagatcaaatcaaacaaatagctaaggctaaagggaagagtattgctcagatttgtttgagatggggatttgaacatggagtgagcattttaccaaagagcttcaacaaagaaaggttgaaagaaaatatggagatatttgattgggagctaagcaaggaagagttacaaaagatgaatacctttcctcaaaatagaatttttcaagctgagcatttagtctcacctgatgagggactgtttaaatctgttgctgatttgtgggatggtgaaatctaa

SEQ ID NO: 24 - DNA, 954 bp, Jeffersonia diphylla
atggggattgttcctgaggtgacattgaactctggccatcagatgcctcttgtaggctttggaacagcacagtttccttttccagagggggatgaagcaaaacaaattatagctccaatactatgtggaatcaagagtggttacagacacttcgacacagcttccctgtacaaaactgaggaagcacttggagaagctataaaagaggcacttcgtcttggccttatcaaatctcgagacgagctattcattacctcgaagctttggtgtactgattctcatcaagatcttgttcttcctgcccttaagaagactctccagaatcttcagatggactaccttgatctataccttgtacattttccagtaagctcaaagccgggaaagccagagttcccaccacagaaagaggaccttcttcctatggattttggatcggtatgggcagcaatggaagagtgccagaggctcggtctaaccaaatcaattggagtcagtaatttctcttgcaaaaagttagagcaactactcacaacagcaaagattattcccgcggttaacgaagtggagatgagcccagtttgccaacagaataagctgagagagttttgtaaggtaaaaaacattgttgtgactgcttactctcctctaggtggaggaagcaatgcagttaaggacaataaggtgctgaaagaaattgccaaggctaaaggaaaaacatgtgctcaggtcactctgagatgggtatacgagcaaggtgttgctctggtgcctaagagcttcaatgaggggaggatgaaggaaaacctggatatatttaattggacaataagtgaagaagagttcaaacagatcagccagttaccacagggtagagtggcaactggagaatggtttgtgtcggttgaagggccattcaagtctctagaggaactatgggatgaagtgatctga

SEQ ID NO: 25 - DNA, 966 bp, Mahonia aquifolium
atgggtgttgtacctgtggtaaccctgaactctggtcatgagatgccactagtaggctttggaacagcagtgcctgccttcgggggatcagacgccataaagcaagcaatactatgtggaatcaagaatggttacagacacttcgacactgcttctgtataccaaacagagaagtcgcttggagaagctatagtggaagcgcttcgccttggcctcatcaaatctcgagatgaactcttcattacctccaagttatggtgtacagatgctcatcaagatggcgttctccctgcccttagggagactctcaagaatcttcagttggattaccttgatctttaccttatacattggccgctaagcgcaaagccagggaagcatgagtaccaaataccaaaggatgagcttcttcctatggactatgaatccgtatggggagcaatggaagaatgccagaggcttgacctctctaagtccattggagtcagcaacttctctatcaagaagcttgaagagctactcaaaactgcaaagattattcctgcagttaatgaagtggaagtgaaccctgtttggcatcaaaataagctaatagagttctgtaaggccaaaggtattgttgtgactggttactctcctttaggtgccaaaggaacaacttggggaaccaatagagtcatggacaatgaggtcctgaaagagattgctaagactagaggaaagacccatgctcaggtttgtctgagatggatatacgagcaaggagttggcctggtggcgaagagctttaatgaagagaggatgaaggagaatttagagatatttgattgggcattgactgaagaagagtctaaacagatcagccagttaccacaatataaagggcaaaatggagaaacgtttctctcagctgaagggcctttcaagaccttagaggagctatgggatgaagagatagcagcttga

SEQ ID NO: 26 - DNA, 963 bp, Menispermum canadense
atggcgagtgttccagaggtgacactgagctctggccatccaatgcctctctttggcttcggcaccgcagcctggccttttgtgtcttcagaaggagctaagtctgcaatattgtgtgggatggagctcggttacagacacttcgacactgcttccatttacggcacagagagctctctcggcgaagccatagccgaagctcttaagctcggcatcatcaagtctcgcgacgagctcttcatcacctctaagctctggtgctgcgacgggcaccatgaccgagtcttgcctgcccttcaaatgactctaaagaatcttcaattggactacattgatctgtatctcgaacactggccattgagctcagtccctaaaggtgagcttgagtacccaataccaaaagaaaaactgtttcctatggatttgaaggctgtgtgggaagccatggaagagtgccagaggcttggcctcaccaagtccattggagtcagcaacttctcttgcaagaagcttgaagatttactcgccttcgcgaagatccctccggccgtcaatgaagtggagatgaacccagtttggcaacagaagaaactgagggacttctgtaaggctaaaggtattgttttgacggcttactcagtgttaggagccaaaggaaccctttggggcactaacaaagttatggactctgaggtgctaggaaagattgccaaggcaagaggcaagactgttggtcaggtttgtttgagatgggcatatgagcaaggtgcgtgtgtgttggtgaagagcttcaatgaggaaagaatgaaagagaacttagagacatttaactgggagttaggagaggaagacttgaagatgattagtgaaataccacaatataaaggacttcgtggtgaggatatggtggctcctaatgggccttacaagactttagaggaactttgggatggagagatatga

SEQ ID NO: 27 - DNA, 1026 bp, Menispermum canadense
atgggagttgataagacaaacgagttctctaatggcaacgcagcgagcccagtactgatcaaagaggctaacctctttaagattgccgaggtgacgttgaactccggtcaccatatgccggttctgggaactgggacggcttcgtttccgtttcctccgttgaaggagctgaagaaggcgatcgtggaagccatggaagtgggctatcgccacttcgactcggccgcgctgtaccagagcgaggaagggctcggtgcagccatagctgaggctttggagaagggacttgtgaagaagagagaagaactattcatcaccaccaagctatggtgcaataatgcccactctgatcgtgtcctgcccgccattcgtgaatctctcaggaaactaagactagactatgtagatttgtatttgattcatttcccagtaaggctgaaggaagatttattggatatgaattgtaagaagggtgggatttttgaacttgacctcaaatcagtatgggcagcaatggagcagatacaacacctaggtcttgcaaagtcaattggagtcagcaacttcacttgtaagaagcttactgaccttctttcttatgcaaagatccctcctgcagttaatcaggtagaaatgcatccagtgtggcaacaaaagaagcttagagacttctgcaaggagaaaggcatccatgttagtgcatattctcctctaggagcaaagcaatggggatttgatgttgttctcggtaacaaaatcttgaaagagattgcacaagacaaaggaaagacaattgctcagattgctttaagatggggatatgagcaaggagtgattttgatcccaaagagctttaacaagggaaggttgactgaaaatcttcgcatatttgactggaagctaactgaagatgaattaaagaagatttcatcaattcaacagagccgagtagctataatgcctgaatttgtgtttcctgaaagtccattcaagacctttgaagatttctgggatggggaaatgtga

SEQ ID NO: 28 - DNA, 969 bp, Menispermum canadense
atggaaggaggaggagttcctaagatactcttgaattcagggcataggatgcctgtgcttggaatgggcacagcttccttcccaatctcaccacaacacctcgtcaagtcttccatactaaccgctatcgaacttggctacacccacttcgacaccgcaagcgtctatgagactgagcctacactcagccgggctatccgccaagccctcgagggtagacacattgcgagccgagaccagctcttcatcaccaccaagctctggtgcggccaagcacaaagcgatctcgtcgtcccagctcttcgcgaatcacttcaggaacttgggttggactatgttgatctgtacttgattcattttccagctagatttaagtgtgtggagaagacatttaatgtcaccaaagaggatcttcttcctttggacatgaaggggacatggcaggccatggaggagtgttgtaaacttggcctggccaagtccattggtgtcagcaacttcagctgcaagaagctctctcagattctcacctttgccaccatccctcctgcagtcaatcaggtggaaatgcacccattatggcagcaaaggaaactgagagagttctgtaaggagaaaggcatccatgtgagtgcctactctcctttaggtgggaaaggtgccaagtggggttccaatgcagtgtttgaatgtgaagaaatcaaacagattgctgaagctaaagggaagagtttggctcagatttgtctgaggtgggcttttgagcaaggtgtgagttttgtgccaaagagctttaacaaggaaaggttgaaagagaacatggagatatatggttgggagctgagcaaggaggaattgcaaaagttaagtgttctgccacagtgcaggatcttcaaaggagaatggctagtgtcagctgatcatggagtgttcaaatcagttgaagatttgtgggatggagaaatataa

SEQ ID NO: 29 - DNA, 960 bp, Nandina domestica
atggtgagtgttccagaggtaaccctgaactccggtcaccggatgcctcttgtgggtatgggcacggcatgctttcctcttccaggatcagaagtggtgaagtcggcgatggtaacggcaatcaagcttggttatcgccacttcgataccgctgcgctttaccagagcgagcagcctctaggtgaagctatagctgaagcacttcaccttggcctcataatatctagggatgaactttttatcacctccaagctatggtgtactgatgctcaccaagatcttgttctccctgctcttaagacaagtctccgaaatcttcagttggattaccttgatctttaccttatacattttccggtgagtttgaagccagggaagatacagctgccggtaccaaaggaagagcttcttccaatggatttcaagtctgtgtgggcagccatggaggaatgtcagaagcttggcctcacaaagtccattggagtaagcaatttctcttgcaagaaactcgaacacatactttcattggcaaagattcctcctgcagttaatcaagtggagctgaacccaatttggcgacaaaaaaagctcatcgagttttgtaaggccaaaggtattgttgttacggcatattctcctttgggagctgtagcacccggtcaaggcagcaatagagtcatggaatgtgaagtgctgagcgagattgcaaaagctcgaggaaaaactcatgcgcaggtttgtcttagatggataattgagcaaggggtcagtttagttgtgaaaagcttcaatgaggacaggaagaagaagaacttggagatattcgactgggaattgagcgaagaagattccaaaaaaatcagccagataccagagactagaggaaaccccggagattttgtcatctctgttgatggtccttataagtctagagaggagctttgggatggagaaatctga

SEQ ID NO: 30 - DNA, 960 bp, Nandina domestica
atgggaagagttcctgagactaccttgagttctgggcataacatgccattgttggggatgggaacagcaaccttccctctccctccatctgaattgatagaatcttatattcttgctgccattgaaatggggtatagacactttgacactgctagtgtttacgacacagaagtaccccttggtcgagccatatctgaagccctccggagaggtcttgtggcaaatcgtgatgaactcttcattaccaccaaactctggtgtggtcatgcacatccagatctcgttgttccagctcttcaccaatctctcatggaaatgggattggaatatgtggatttgtatttgattcattttccagctaggtttaacaaaaaggaaaagaactttgatgtgaagaaagaggaagtcattcccttggacatgaagggaacatgggaagccatggaagagtgtagcaaacttggacttgcaaagtccattggtgtaagcaacttcagctgcaaaaagctctctcaactcctcacctatgccactatccctcctgcagtgaatcaggtagaaatgcaccctctttggcaacaatggaaattgagagaattttgcgtagcaaatgatatacatgtgactgcctattctcctctaggggggaaaggagcattgtggggttcgaattcagtgctcgattcaaaagaaatccaacaaatggctgaagcaaaaggaaagagtatcgctcagatatgtttgagatgggcatttgaacaaggagtaagcttcataccgaaaagcttcaatgtcgaaaggctaaaagaaaatatggaaatatttgattgggaaatgaacaagaatgagttgttgaaaatgagtttgcttccacaaaaaaggactttcactgcagaatatttggtatcacctgatggggcgtttaaatcggttgacgatttatgggatggggagatataa

SEQ ID NO: 31 - DNA, 960 bp, Nigella sativa
atggcaagagtacctgagataaccttaaactccggccaccggatgcctctcttgggtatgggaactgcagtagttccctttaaagaaccagaaccagtgaagtcagcaatactcactgcaatcaagaatggttacaggcacttcgatacagcttctctgtaccgaactgagccagcccttggagatgctatagctgaagcacttcaacttggcctcatcaactccagggacgaccttttcatcacctccaagctctggtgcactgacaaccaccctgatctggtcctccctgcactgcacacaacacttcgaaatctgaagttggactaccttgatctatatctaatacattggccagtaagcatgactccagggagaattcggttccctgggccggatgagaagatacttccaatggattacaagtctgtatgggcagccatggaagagtgtcaaaagcttggcctcacaaaatcaattggagtcagcaattttacctgcaagaagcttgaattgttactggcatcagctactatccctcctgctgttaatcaagtggaggtgaaccctatgtggcaacaggaaaagctgatagagttttgtaggactaaaggtattgttgtaacagcttacgctcccttggggactgttggaacatttataggtaacaacgatattatgaactgtgagttactgaaagaaattgcccaagctaaaggaaagacaaatggtcagatttgtctcagatgggtacatgaacaaggagtgggtctgctagtaaagagcttcactgaggtgagaatgaaacagaatcttgagatatttgattgggaactaagtgaagaagaatcaatgaaaattaaacaactgccacaaagaaagagtcatcaagggaagggctttgttactgctgatggaccattcaaatcgttgacagagctttgggatggagagatgtga

SEQ ID NO: 32 - DNA, 954 bp, Nigella sativa
atggtttatgagatcatgttgaactctggatacagaattccattgctgggaatgggaacagcagcctatccagtgcctccaccagagctagtggagtcttctgttcttgctgcaattgaactcggttataggcactttgacactgcccatatttatggaacggaagcacctttgggaagagccatatcagaagccttgaggaagggattgatcaaaagtcgagatgaactcttcataactactaagctctggcctggccatgcacgccctgatcttgttctacaagctttgcatcaatctttagaagctttgaggattgattacgttgatctgttcctaattcattttccagcacggtacaacacaacagaaataagaatggatataaagaaggaagacatccttcctttggatatcaagggaacatggcaggccatggaagagtgttgtaaacttggcttggccaagtccatcggtgtcagcaacttcggttgcaagaagctatcccaactattggattcagccactatcccacctgcagttaatcaggtggaaatgcatcctctctggcaacaagcaaaactgagagagttttgtgcagaaaggggtatccatgtcagtgcctattctcctttaggaggaaaggggactctctggggatccaatgcagtgcttgattctgagcaaatcaaacagattgcacttgctaaggggaagagtgtagcgcagatatgcttgagatggggttttcaacaaggagtaagcatcatagcaaagagcttcaacagagaaagactcaaagaaaatatggaaatatttgattgggaattgaacaaggaagaactatacaagctaagcatccttcctcaaaataggatttcaacccttgaatatttagtgtcaccggatgcagttttcaaatcaattaacgatttgtgggatgaagaagtttga

SEQ ID NO: 33 - DNA, 957 bp, Nigella sativa
atggataacagtgtagtagtgctgaattctggacatagaatgccattgttagggatgggaacagcagccactcctttacctcccaatgaagttgtccagtcttcagttcttgctgcaatcgaactgggttacaggcattttgatacagcaagtgtgtatggctcagaagtgattttaggtagagccatatctgaagctttaaggagaggtttggttgctagtagagatgagcttttcataactactaagctttggtgtggtaatggacaccctgatcttgttcttggtgctcttcaagaatctttaagaattatggagctggattatgtggacttgtacttgattcattttcctgtgagattcaatataacagagaagctcttaaatatgaagaatgttcctcttcttccttttgacatggaagggacatggcaagctatggaggagtgttgtagactgggtttagccaagtccattggtgttagcaattttagttgcaaaaggctatctgaacttctactttccgcttccatccctcctgctgtgaatcaggtggaaatgcatccgctttggcagcaaagaaatatgagagagttttgtagaaaagaaggaattcatgtgagtgcttattctcctttaggaggaaaaggagcagcttgggggtcgaatgcagtgctagattctgaagatatccaacaaatagctcaacataaagaaaagagtgttgctcaggtatgcttgagatgggcgtttgagcaaggagtgagcattatagtaaagagtttcaataaagaaaggcttaaagaaaatacacaaattttcgactgggagctcaacaaacaagagttgcagagaatcaatactcttccacaaaataagatttttaaagcttcaaatttgatttcagcagatggaccatataaaacatttgaggaattgtgggatggagaggtatga

SEQ ID NO: 34 - DNA, 960 bp, Papaver bracteatum
atggagagtaatggtgtacctatgatcactctcagttccggcattcggatgcctgctttaggtatgggaacagttgaaacaatggaaaagggaacagaaagagagaaattggcgtttttgaaagcgatagaggtcggttacagacacttcgatgcagctgctgcatatcaaactgaagagtgtcttggtgaagctatagctgaagcacttcaacttggtctaattaaatctcgagatgaactcttcatcacttccaagctctggtgcactgatgctcacgctgatctcgtcctccctgctcttcagaattctctgaggaatcttaaattggagtatctggatctatatttgatacactttccgctaagcttgaaaccagggaagattgttaacgaaataccaaaggatcaaatgcttccaatggactacaaatctgtgtgggcagccatggaagagtgtcagacccttggcttcactagggcaatcggtgtcagcaatttctcatgcaaaaagcttcaagagttgatggcgacagccaacagccctccagttgtaaatgaagtggagatgagcccgattttccaacaaaaaaaattgagagcatattgcaaggccaataatatcatgatcactgcatactcggttttgggatccagaggagccgcatggggcagcaatgcagttatggattctaaggtgcttcacgagattgctgtgtccagaggaaaatctgttgctcaggttagtatgagatgggtttaccagcaaggcgcgtgtcttgtggtgaaaagtttcaatgaagagagaatgaaggaaaaccttaagatattcgattgggagctatcggcagaagacatggaaaagatcagtgagattccgcaatgtagaacaagctctgttgatttcttgttatcaccgactgggcctttcaaaactgaagaagagttctgggatgagtag

SEQ ID NO: 35 - DNA, 966 bp, Papaver bracteatum
atggagattaatggtgtaccagtgatcagtctaagctcgggcgttcggatgcctgctttaggtatgggaacagctgaaacaatggaaaaaggaaccgacagagagagatcagcgtttttgaaagcgattgaggtcggttacaggcacttcgatacagctgctgcttatcaaactgaagagtgtcttggtgaagctatagctgaagcacttcaacttggtctaattaaatctcgagatgaactcttcatcacttccaagctctggtgcactgatgctcacgctgatctcgtcctccctgctcttcagaattctctgaggaatctcaaattggagtatcttgatctatatttgatacacgctccggtaagcttgaagccagggaagattcttaacgaaataccaaaggatcaaatgcttccaatggactacaaatctgtgtgggcagccatggaagagtgtcagacccttggcttcactagggcaatcggtgtcagcaatttctcatgcaaaaagcttcaagagttgatggcgacagctaatagccctccagtggtaaatgaagtggagatgagccccactttacatcaaaaaaatctgagagaatattgcaaggccaataatatcatgatcattgcatactcggttttgggagccagaggaaccggatggggcagcaacgcagttatggattctaaggtgcttcaccagattgctgtggccagaggaaaatctgttgctcaggttagcatgagatgggtttaccagcaaggtgcgtgtcttgtggtaaaaagtttcaatgaagagaggatgaaggaaaaccttaaaatattcgattgggaactaacggaagaagacatggataagatcagtgagattccgcaatccagaacactatctgctgatttcttgttatcaccgactggacctttcaaaactgaagaagagttctgggatgaaatggtttga

SEQ ID NO: 36 - DNA, 972 bp, Papaver bracteatum
atgaggaatactggtgtacctgtaatcactctgagctcggggaaggggatacctgttttaggtatgggaacatttgaaacagttggtaaagggggtgaacgagagaggttggcgtttttgaaagcgatagaggtgggttacagacacttcgatactgctgcgtgctaccaaactgaagagtgtcttggtgaagctatagaggaagcacttcaacttggcctaatcaaatctcgagatgaactctttatcacttctaagctctggtgcaccgacgctcaccctgaccgtgtcctgttggctcttcagaattctctgaggaatcttaagttggagtatctggatctatacctgatacactttccagtaagcttgaagccagggaatgaggttactatggatgcagcagggggcgaaatttttctaatggactacaagtctgtatgggcagccatggaagagtgtcagaaccttggcttcactaagtcaatcggtgtcagcaatttctcctgcaaaaagcttcaggaattattggcgacagcaaacatccctccagttgtaaatcaagtggagatgagcccagttttccaccaaaagaatctgagagagtattgcaaggccaataatatactggtggctgcatactcgattttgggaggcaagggaaccgcatggggctccaattcagttttgggttccgaggggcttaaccagattgctatcgccagaggaaagtctattgctcaggttagcatgagatgggtatacgagcaaggcgcgattcttgtggtgaaaagtttcagtgaaaagaatatgagggaaaacttgaacatattcgattgggaactgactaaggaagacctggaaaggattggtgagattcctcagcgcagattaataattcaggaatttatggtatcatctaatggacctttcaaatctctagaagagttctgggatgaaaaagctgattga

SEQ ID NO: 37 - DNA, 966 bp, Papaver bracteatum
atggagaatgtaatacctgcagtgacattaagttctggaagtgtgatgcctatattaggtatgggcactgctgcatacccattagttgaaccagaagaagcgaaattggcgtttttgaatgctatcaagattggttacagacattttgatacagctgcttcttaccattgtgaaggatttcttggtgaagctatagctgaagcacttcaacttggtttgataaaatctcgagacgaactgtttatcacttctaagctctggccctgtgatgctcaccctgaccttgtcatccccgcaattcagaactctctaaggaatctaaagttggagtaccttgatctatatctgatacattttccaataagcacgaaaccagctgcagggcttgtttttccgccaccaaaggatgctttgcttccaatggattacaagtctgtatgggcagctatggaagagtgtcaaaaacttggtcttacaaagtcaattggtgtcagcaacttctcttgtaagaagcttcaaaccattttggacattgctaacatccctccagctgttaaccaagtggagatgaacccagtttggcagaacttgaaattgagggacttctgcaaggctaacaatatcgttctcactgcctactcacctttaggagccaggggaaccccgtgggggtctaatgcagtctatgaggagcgagttctgcatgaaattgctgaggctaaagggaaaactcatgcacaggtgtgtctaagatgggtatacgagcaaggagtgagtcttatagtcaagagcttcaatgagttgaggatgaaggagaatatgatgattttcgactgggaactgactgaagatgaactgcaaaagataggcaaaatcccacagaggagaggactcccaggtgatttttttgtctcggaagcagcgcctttcaagactgtcgaagaattttgggacggagaaatttga

SEQ ID NO: 38 - DNA, 969 bp, Papaver bracteatum
atggaggttgtaatccctaaagtggcactgagttctggtagagtgatgcctgtgctaggaatgggcacatcatcattcccgccagttggtccggaagatggaaaagccgccattttgaatgctatcaagattggttatagacactttgatacagcttctgtttacaagtctgaagacttcctcggtgaagctatagctgaagcacttctacttggattgatccaatctcgagaccagcttttcattacttccaagttatattgcaatgatgctcaccctgatcttgttgtccctgctttacagaactctctcaggaatctgaggctggagtaccttgatctatatctgatacactttccggtaagctcaaagccagtcaagtacgagtatcatctaaaaaaggagcatctcctccctatggactacgaatctgtgtgggcagccatggaaaagtgtcaaaagcttggacttacaaagtcaattggagtcagcaatttctcttgcaagaagcttcaaactattttggacactgctaacatctctcctgctgttaatcaagtggagatgaatccagtttggcaaaacttgaaactgagggatttctgcaaagctaaaggtatcgttgtcactgcctactcacctttgggagccagcggaaccccctggggatctaatgcagtcaaagaagcacaggaattgcacgaaatcgcaaaagctagagggaaaactcatgctcaggtttgtcttagatgggtatacgagcaaggagtgagcttgctagtcaagagcttcaaagaagaacggatgaaagagaacctaatgatctttgattgggagttgactaaagatgatttgttcaaaatcagcaaaattacacaacgcagaggactaccaggttataggttcatctcgaaacttgaagggtcacccttcaagacggtcgaagaattctgggatggagaagtttaa

SEQ ID NO: 39 - DNA, 966 bp, Papaver bracteatum
atggagagtagtggtgtaccagtaatcactctgagatcgggcaaggtgatgcctgttttaggcatgggaacatttgagaaagctggtaaagggtctgaaagagagaggttggcgatattaaaagcgatagaggtgggttacagatacttcgacacagctgctgcatacgaaactgaagaggttcttggagaagctattgctgaagcacttcaacttggcctaatcaaatctcgagatgaacttttcatcagttccatgctctggtgcactgatgctcaccctgatcgtgtcctcctcgctcttcagaattctctgaggaatcttaaattggagtatgtggatctatatatgttacccttcccggcaagcttgaagccagggaagataacgatggacataccagaggaagatatttgtccaatggactacaggtctgtatggtcagccatggaagagtgtcaaaaccttggcctcactaaatcaatcggtgttagcaatttctcctgcaaaaaacttgaggaattgatggcgaccgccaacatccctccagccgtgaatcaagtggagatgagcccggctttccaacaaaagaagctgagagagtattgcaacgcaaataatatattagtcagcgcagtctctatactgggatcaaacggaaccccatggggctccaatgcagttttgggttctgaggtgcttaagaaaattgctatggccaaaggaaaatctgttgctcaggttagtatgagatgggtttacgagcaaggcgcgagtcttgtggtaaaaagtttcagtgaagagagattgagggaaaacttgaacatattcgactggcaactcaccaaggaagacaatgaaaagatcggtgagattccacagtgcagaatcttgagtgcttattttttggtctcacctaaagggcctttcaaatctcaagaagagttgtgggatgacaaagcttga

SEQ ID NO: 40 - DNA, 972 bp, Papaver bracteatum
atgggaagtagttgtattcctgttctcactttgaactcgggcaataagatgcctgttttaggtatgggaacatttgaaacatttgctaaagggggtgaaagagaaagattggcgtatttgaaagcgattaaagtgggttacagatacttcgatacaggcgctgcatacggaacggaagaggttcttggccaagctatagctgaagcacttcaacttggcctaataaaatctcgagatgaactcttcatcagtaccatgatctgggccactgatgctcaccctgatggtgtcctccccgctgttcagagatctttaaggaatcttaaattggactatgtggatctctacctgataccatttccggcaagcttgaacccagaaggggagatacctaattacataccagagaacgaaacttttttaaaaatggactacaagtctgtatgggcagctatggaagagtgtcaaacccttggctttaccaagtctatcggtgtcagcaatttctcctgcaaaaagcttcaggaagtgatggagaccgcaaatatccctccggctgtcaacatggtggaaatgaaccctactttccaacaaaaatatctgagagagtactgcaaggccaataatatattagtcaatgcgtactctgttttgggatccacgggaacttcatggggctccaatgcagttatgggttctgaggtgcttaagcaaattgctacggacataggaaaatctattgctcaggttagtatgagatgggtttacgagcaaggtgcgggttttgtggtaaaaagtttcagtgaagagaggatgagggaaaacttgaacatattcgactgggagctgactaaggaagacttggagaagatcagtcagattccacaatgcagagtactacctatggattttttggtatcatctgatggagctttcaaatctttggaagacttgtgggatggtgaagcttga

SEQ ID NO: 41 - DNA, 912 bp, Papaver bracteatum
atgccgatcttaggttttggaacagctgaaaacctttttgaagggggtgataaagtgaagttggcgattttgaaagcgatagaggtgggttacagatacattgatacagctgccgtgtaccgaactgaagagtctgttggtgaagctgtagcagaagcacttcaacttggcttgataaaatctcgagacgagctattcataacctccaagctatggggtgtcgatgctcatcctgatcttgtcctcccagctcttcagaactcattgaggaaacttaaattggagtatttggatctgtatctgatacactatccggtaagcttgaagccaggggagatggtcgatgatataccgaaggacgaaatatttccactggactacaagtctgtatgggcagccatggaagagtgtcagaagcttggctacactaagtcaatcggggtcagtaatttctcttgcaaaaagcttcaacagcttatggccacagctaacatacctccagctgtaaatcaagtggagatgaacccaacttggcaacaaaagaatctaagggaatactgtaaggccaacaatatcttcattacagcatactcgactttgggagctaaagaccttttatggggctccaatgcagttttaggctctaaagtgttgaaccagattgccgtggccagaggaaaatcagttgcccaggttagtctgagatgggtttacgaacaaggtgtgagtcttgtggtgaaaagttttaacgaggagaggatgaaggagaacttgaagatatttgattgggaactgaccacagaagacttgaaaatgatcagtgagatccctcaacgcagagtagcaactgcggatttttttgtgtcagatattggacccttcaaatctttagaagagctgtgggatgaataa

SEQ ID NO: 42 - DNA, 921 bp, Papaver bracteatum
atgccggttttaggactgggaacagctgaaaaccttactaaaggttctgaaagagagatgctggcgattttgaaggcgatagaggtgggttacagacactttgatacagctttcatataccaaactcaagagtgtgttggtgaagctatagctgaagcacttcaactaggtatcatcaaatctcgggatgaactctttatcacttccaagctctggggttctgatgctcaccctgattgcgtcctcctggctcttcagaattctctaaggaatcttaaactgcagtatctggatctatatctgatacactatccagtaagcttgaagccagggacaactttgaaagatttggggaataaggacaacttccttccaatggactacaagtctgtatgggcagctatggaagagtgtcagaagcttggcctcactaagtcgataggtgtcagcaacttctcctccaaaaagattcaagagctaatgagcacagacagcatccctcctgccgtaaatcaagtagagatgaaccccacatggcaacaaaagaaactgagagaatattgtcaggccaacaatatcttagttactgcatactctcctttgggagctaaaggaaccacatggggatccaatgcggttatgggatctgaggtactgaaccagattgcccttgccagagggaaatctgttgctcagattagtctaagatgggtttacgagcaaggtgtgagtctcgtggtgaaaagcttcaatgaagagaggatgagggagaacctgaaaatatttgactgggagctaactgccgaagacttgaaaaagatagatgagcttccacagagcagagtggcaactgctgaatttgttgtatcagagaatgggcccttcaagtctttagaagaattttgggatgacgagtcctga

SEQ ID NO: 43 - DNA, 966 bp, Papaver bracteatum
atggagaatgcaatacccgcggtaacattgaattctggaagtgtgatgcctgtattaggtatgggaactgctgcatacccatttgtcgaatcagaagaagcgaaattggcgattttgaatgctatcaagactggttacagacatttagatactgctgctctttaccagtctgaagaatcacttggtgaagctgtatctgaagcaattcaacttggtttgataaaatctcgagacgaactgtttatcacttctaagctctggccctgtgatgctcaccctgaccttgtcatccccgcaattcagaactctctaaggaatctaaagttggagtaccttgatctatatctgatacattttccaataagcacgaaaccagctgcagggcttgtttttccgccaccaaaggatgctttgcttccaatggattacaagtctgtatgggcagctatggaagagtgtcaaaaacttggtcttacaaagtcaattggtgtcagcaacttctcttgtaagaagcttcaaaccattttggacattgctaacatccctccagctgttaaccaagtggagatgaacccagtttggcagaacttgcaattgagggacttctgcaaggataagagtatcattctcactgcctactcaccattagaagggaagggaaccccgtgggggtctaatgcagtctacggagcacaagttttgcatgaaattgctgaggctaaaggcaaaactcacgcacaggtttgtctgagatgggtatatgagcaaggagtgagtctgctagtgaagagcttcaatgatcagaggatgaaggaaaacatgatgattttcgattgggaactgaccgaggatgaactggaaaagataagcagaatcccacagaggagaggactcccaggtgatttttttgtctcggaagcagcgcctttcaagactgtcgaagaattttgggacggagaaatttga

SEQ ID NO: 44 - DNA, 966 bp, Papaver bracteatum
atggagaatgcaatacccgcggtaacattgaattctggaagtgtgatgcctgtattaggtatgggaactgctgcatacccatttgtcgaatcagaagaagcgaaattggcgattttgaatgctatcaagactggttacagacatttagatactgctgctctttaccagtctgaagaatcacttggtgaagctgtagctgaagcaattcaacttggtttaataaaatctcgagacgaactttttatcacttctaagctatggccttgtgatgcacaccctgaccgtgtcgtccctactcttcagaactctctaaggaagttaaagttggagtaccttgatctatatctaatacattggccagtaagctcgaacccagtggcagggcatgtgttatcgctgccaaaggattctttggttacaatggattacgagtctgtatgggcagctatggaagagtgtcaaaaacttggtcttacaaagtcaattggtgtcagcaacttctcttgtaagaagcttcaaaccattttggacattgctaacatccctccagctgttaaccaagtggagatgaacccagtttggcagaacttgaaattgagggacttctgcaaggctaacaatatcgttctcactgcctactcacctttaggagccaggggaaccccgtgggggtctaatgcagtctatgaggagcgagttctgcatgaaattgctgaggctaaagggaaaactcatgcacaggtgtgtctaagatgggtatacgagcaaggagtgagtcttatagtcaagagcttcaatgagttgaggatgaaggagaatatgatgattttcgactgggaactgactgaagatgaactgcaaaagataggcaaaatcccacagaggagaggactcccaggtgatttttttgtctcggaagcagcgcctttcaagactgtcgaagaattttgggacggagaaatttga

SEQ ID NO: 45 - DNA, 972 bp, Papaver bracteatum
atggagaatgtaatacctgcagtgacattaagttctggaagtgtgatgcctatattggctatgggcactgctgcatacccattagttgaaccagaagaagcgaaattggcgtttttgaatgctatcaagattggttacagacattttgatacagctgcttcttaccattgtgaaggatttcttggtgaagctatagctgaagcacttcaacttggtttgataaaatctcgagacgaactgtttatcacttctaagctctggccctgtgatgctcaccctgaccttgtcatccccgcaattcagaactctctaaggaatctaaagttggagtaccttgatctatatctgatacattttccaataagcacgaaaccagctgcagggcttgtttttccgccaccaaaggatgctttgcttccaatggattacaagtctgtatgggcagctatggaagagtgtcaaaaacttggtcttacaaagtcaattggtgtcagcaacttctcttgtaagaagcttcaaaccattttggacattgctaacatccctccagctgttaaccaagtggagatgaacccagtttggcagaacttgcaattgagggacttctgcaaggataagagtatcattctcactgcctactcaccattagaagggaagggaaccccgtgggggtctaatgcagtctacggagcacaagttttgcatgaaattgctgaggctaaaggcaaaactcacgcacaggtttgtctgagatgggtatatgagcaaggagtgagtctgctagtgaagagcttcaatgatcagaggatgaaagaaaacatgatgattttcgattgggaactcactgaagatgaactggaaaagataggcaaaatcccacagagtagaggactcccaggtgatgtttttgtctcggaacttgaagctgcccctttcaagactgtcgaagaattctgggacggagaggtttga

SEQ ID NO: 46 - DNA, 960 bp, Sanguinaria canadensis
atggagaacgtctctgtagtgactttgaactcaggaagagagatgccaattctaggtatgggcaccgctgcatacccttctgttggctcagaagaagccaaattggcgattcttcttgcgataaaggtcggctacagacactttgacacagctgctgcttaccagattgagtcttctcttggcgaagctgtagctgaagcacttcaacttggactgctcaaatctcgagatgaactcttcatcacctccaagttatggtgctctgattctcaccctgaacgtgtcctccccgctcttcagaactccctccggaatcttaagttggagtatcttgatctatatctgatacattggccggtaagcttgaagccagggaactttgatctgactatacccaaagaggatttgctccctatggactacaagtctgtgtgggcagccatggaagaatgtcagaaacttggcctcacaaagtcgattggtgtcagcaatttctcttgcaagaagcttcaagatttattggccaccgccaacatccctcccgctgttaatcaagtggagatgaacccaatttggcaacagaagaaattgagggagttctgcaaggccaacggtatccttattacagcctactcaccgttgggagccaatggaactccttggggatccagcggagtcgccaatactgaggtgctacaccaaattgctaaggctagagggaagactcatgctcaggtttgtctaaggtgggtatacgagcaaggagtgagtttgttagtaaagagcttcaatgaagagaggatgaaggagaacctgaagatattcgattgggaactgactgcagaagatttgaaacagatcagcgagatcccacagcatcgaggactccctgctgatattttcgtctcagttaacgggcccttcaagactgtcgaagagttctgggatggcgaggtttga

SEQ ID NO: 47 - DNA, 966 bp, Sanguinaria canadensis
atggagattagtgttccaataacgactctgagctccgggagggagatgccaatcttaggtatgggaactgctgaaaatctattcaatggatccgaaaaagtgaaattggcaattctagatgcgataaaagtgggatacagacactttgatacagctgctgtgtaccaaactgagtcgtctttgggtgaagcagtagctgaagcacttcaacatggactgctcaaatctcgagacgaactcttcatcacctccaaattatggtgctctgattctcaccctgatcgtgtcctccctgctcttcaaacctctctcaggaagcttaagttggagtatcttgatctatatctgatacattggccgttaagctctaagcctgggagccatgattatcctatacccaaggaggatttgctccctttggactacaagtctgtgtgggcagccatggaagaatgtcagaagcttggcctcacaaagtcgattggtgtcagcaatttctcttgcaagaagcttcaagatttattggacacagccaacatccctcccgctgttaatcaagtggagatgaacccgctttggcaacagaagaaactgctggagttttgtaaggggaacggtattatcatcactgccttttcgccgttgggtgccaaaggcacctcctggggcgccaccaacggagttatggactctgaggtgctacaccagattgcccaggctagaggaaagtctattgctcaggtttctctgaggtggttatacgagcaaggtgtgagtctggttgtgaagagtttcaatgtagagaggatgaaggagaacctgaagatattcgattgggaattaagcgcagaagacttaaaaaagatcaacgagatcccacagcgtagaggactccctagtggtagtttcatctcagctaacgggccattcaagtctgaagaagagctctgggacggagaagtctga

SEQ ID NO: 48 - DNA, 957 bp, Sanguinaria canadensis
atggccatggaaaccgttcctaagctacccttaagctccggtgacaattccatcccggtaataggtttcggcaccgccgcgtttccactccccgatgacgaaactttaaaatcggcgtttctcaatgggattgaagccggttaccgtcactttgacacggcggctgcctatggttcggagaaggctctcggcgaagctataaccgaagctttacgtctcggtctgctaaaatctcgagaagaagttttcatcaccactaagctttggtgtagcagttgtgaacgcagcctcgtggttccttcactcaagaatagcctccggaatctacaaatggagtacgtagatcttttcctcatacattggcctgtaagattaagtattgatgcacagcgacctccaattccaagggaacaaattcttactttcgatactaaatcagtttgggaaggaatggaagaatgtcacgaacttggcctcgccaaaaatatcggacttagtaatttttatcccaagaagatcgatgaattgctcgccaccgcaaaaattcccccggccgtccttcaagtggaattgagcccaacttggcaacagaagaatttgatcgaatattgtagggaaaagggtatccttgtcacggcttattctgctttaggagccaacggcacgcattggggagacaatagagtggtggagagcgatgtattaggagacatcgccaaggctagaggaaaaaccactgctcagattgcgttgagatgggtgtatgaacaaggggtgtgtatggtggtgaagagcttcaacaaggaaaggatgaaactaaacctccagatctttgattttgagttgaccgaggaagagtcaaacaagatcagtcaacttccacaaatcaaaggagttaaactatctcccatgtttgggaaccatgatgtactcaaggagcttgaggatcaactctga

SEQ ID NO: 49 - DNA, 987 bp, Sanguinaria canadensis
atgggtgaggaaatgaagtgtggtagggttgttccagtggcgactctgaactccggaaggacgatgccgctcttaggtatgggaacagccgcatatccatttgtcgggtcggaaaaggtaaagtctgcgattcttcatgcgataaagctggggtaccggcactttgataccgctgcgctgtaccaaactgaggagtgtcttggtgaagttgtagctgaagcacttcaacttggactgctcaaatctcgagacgaactcttcatcacttccaagctatggtgctctgattctcaccctgaccgtgtcctccctgctcttcagacctcccttcggaagcttaagttggagtaccttgatctatatctgatacattggccgctaagtttgaagcctgggaactacggatttcccatacccaaagaggacatgctccctatggactacaagtctgtgtgggcagccatggaagaatgtcaaaagcttggcctcacaaagtcgatcggtgtcagcaatttctcttgcaagaagcttcaagatttattggccacagccaacatccctcccgctgttaatcaagtggagatgaacccaatttggcaacaaaagaaactgagagagttttgcgaggccaatggtatccttattacagcctactcgcctttaggagccaatggaaccccttggggctccagcggagtcgcccagactcaggtgctgcacgacattgctaaggctagagggaagactcatgctcaggtttgtgtgagatgggtatacgagcaaggggtgagtgtgttggtgaaaagctacaatgaagagaggatgaaggagaacctgacggtattcgattgggaattggacgtagaggacctgaagaagatcagtactgaaatcccacagcgtagaggacttcctagtgacattttcgtttcagtacttactggacccttcaagtctgcagaagagctctgggatggagagctctga

SEQ ID NO: 50 - DNA, 981 bp, Stylophorum diphyllum
atggagagtgatagtacagcagtagcagttccagttacgactctgagctcaggtattgagatgccaatgttaggtctgggaactgctgatgaaaaacttcttccaagttccgaaacagtgaagttggcttttctgactgcgataaaactagggtacaggcacttcgacacagctgctgtgtaccaaactgaggagtgtcttggtgaagctgtagctgaagcacttcaacttggtctgatcaaatctagagacgaactcttcatcacttccaagctgtggtgctctgatgctcaccctgatcttgtcatccctgctcttcagaactctctccggaagctgaagttggagtatcttgatttatatctgatacattggccgttaagctcaaagccagggaactgtgtttttccaatacccaaggaggacctccttcctttggacttcaagtctgtgtgggcagccatggaagaatgtcaaaagcttggcctcacaaagtcaattggtgttagcaacttctcttgcaagaagcttcaagatttactggccatggctatcatcccgcccgctgttaatcaagtggagatgaacccacattggcaacagaagaaactgagggagttttgtaaggtcaaagatattgtcgttacagcctactcgcctctgggagccaaaggcaccccatggggctccaacgcagttatggactccaaggtgctacatcagattgccaaggctagagggaagtctgttgctcaggtttctcttagatgggtataccagcaaggtgtggttttgttggtgaagagtttcaatgaagaaaggatgaaggagaacatgaagatattcaattgggaactgaacgaagaagacttaaaaatgatcgacgagatcccacaatgtagaggcaaccctagtcattattacgtctcagaaaacggaccattcaagactgttgaagaattctgggatggagaagtctaa

SEQ ID NO: 51 - DNA, 924 bp, Stylophorum diphyllum
atgccaattgttggtatgggaacagctgaaaacctttttgaaggttcagaaagagtgaagttggctcttctgactgcaataaaggtgggttatagacactttgatacagctgctgtttaccagactgaggggtctcttggtgaagctatagctgaagcacttcaacttggactgatcaaatctagagacgaactctttataacttccaagctgtggattcatgattgtcaccatgatcttgtcctccctgctcttcagaattctcttaggaagcttaagttggagtaccttgacctctatttgatacattggccagtaagctcgaagccaggggagctcaggtctcttataccaaaggaggagctcctcccaatggatttcaagtctgtgtgggtagccatggaagaatgtcacaagattggcctcacaaagtcaattggtgttagcaacttctcttgcaagaagcttcaagatttattgctcactgccaacatccctcctgctgttaaccaaaaggtggagatgaacccactttggcaacagaagaaactgagggagttttgtaaggccaacggtatcgtcattgcagcttactcgcctttaggagccaaaggaaccttgtggggaaccaacggtgttatggactctgaggtgctacaacagattgccaaggcaagacgaaagtctattgcgcaggtttctctacgatgggtatatgaacaaggggtggttttgttggtgaagagttttaatgaagggaggatgaaggaaaacctgaagatattcgattgggaattaagtagagaagacttgaaacaaatcaacgagatcctcccacagcgtagaggactccctagtcatgtttttgtctccgatgacgggccattcaagtctgaggaagaactgtgggatggagaagtgtga

SEQ ID NO: 52 - DNA, 957 bp, Stylophorum diphyllum
atgaccatggaagctgttccaaaggtaaccttaagcaccagtggcaaatccatgcccataattggtttcggcaccgccttgtttccgactggcaatgacgaagccgtgaaatcagcggttctaagtgggattgaagctggttatcgtcacttcgacacagcagtcgcctacagatccgaaaagggtctcggtgaaggtatagcagaagctctacgtctaggtctgatcttatctcgagacgaagttttcatcaccaccaagctttggtgtactagttgcgagcgcagcctcgttgtaccttcactcaagaacagcctccgaaatctacaaatggaatacgtagatctttttctcatacattggcctttacgactaagtgccgatgcacaacgacctccgattcgaaacgatcagatacttcatttcgatacgaaatcagtttgggaaggaatggaagaatgttatgaactaggcctcgccaaaaatataggagttagtaacttctatcccaagaagattgatgagttactcgccactgcaaaaattcctccagcaatcaatcaagtggaattaaacccagcttggaaccagaaggatctgatcaagtattgtaagtcaaagggtattcttatcacggcttactctgctttaggagccaacggaacgcattggggagataaccgagttgtggacagcgatgtgctgaaggacatcgcgaaagctcgaggaaaatccacagctcaggttgcattgagatgggtatatgagcaaggggtgagtatggtggtcaagagctttaacaaggaaaggatgaaacagaaccttcagatcttcgattttgagttgacggaggaagagtcaaacaagatcagtcaacttccacaacacaaaggtgttaaacttactccagtgtatggcgaccatgatgccatgaagaagattgacaatgagatctga

SEQ ID NO: 53 - DNA, 960 bp, Tinospora cordifolia
atggtgagtgtacctgaggtggttctgagcaacgggcacctcatgcctgtggttggtatgggcatggcggcctacccattccaagaatctgaaacagtgaagcaggcaatgatcagggcaattaagatgggctacaggcattttgacacagctgccttgtaccaaacagagaagtcccttggagatgcaattgtagaagcactaaagcttggcctcattaaatctcgtgacgagcttttcatcacttccaagctgtggtgcagtgatgctcatccccatcacgtcattccggctcttcaaagaactctgaggaatcttgggttggagtaccttgatctctatctcatacactggccagtaagctcagaacctggcaaatacgagttcccagtacgaaaggaagagctaattctgatggattttgaaaatgtatgggcagatatggaagaaggatataggcttggcctcacaaagtcaattggtgtaagcaacttctcttgtaagaagctcgaaagtttactcactatggcaaagatccctcctgcagtgaatcaagtggagatgaatcccctctggagacagaataaactactaaggttttgtaaggacaagggcattgctatcactgcttactcaccactgggagccaaaggaactatatggggcactaacagagtgatggaaagcgaggtgctaaacgatactgccaatgctagagaaaagactcttgctcaggtttgtctaagatgggtttatgagcaagaagtatccatattggtcaaaagcttcaacgaagagaggatgaaggagaacttagacatttttgattggaaattaagtgacgaggacttggaaaagatcaatgagattccacaatgcagaggacttccaggtgatatctttgtatcagatgatgggcccttcaaatctgaagcagagctctgggatggagaaatctga

SEQ ID NO: 54 - DNA, 990 bp, Tinospora cordifolia
atggtgggagttaacaaggagaacgtggtttcatcagtagcaacggtgccggtggtgacgctgaactccggtcataaaatgccagtgctgggaacgggcacagcttcgtttcctgttcctccattagaggaactgaagaaggtgatcatggaagccatggaagtgggctaccgccactttgatacagcagccatgtatcaaagcgaggaagggctcggtgcggccattaaagaggccttagagaagggtctaattaagagcagagatgagcttttcatcactaccaaactttggtgcaataatgcccaaccccatcttgtgctccctgccatccgcgactctctcaggaggctaaggttggaatatgtggacttatatttgattcattatccagtaaggctgaaggaagatttattgagtatggactgcaaggaggatgaaatatttcccattgacataaaatcagtatggtcggcaatggaggaaatacacaatcttggtcttgcaaaatccattggagtcagcaacttcacttgcaagaagctcactgatctacttgctcatgcaaagatccctcctgcggttaatcaggtggaattgcacccagcatggcaacaaaaaaaattaagagaattctgccaggagaaaggcatccaagtcagtgcatattctcctcttggagctaagcaatggggatttgatgttgttcttagcaataagatcatcaaagagattgcccatcacaaaggaaaaacggttgctcagattgctttaaggtggggacatgagcaaggaataattttaatcccaaagagcttcaacaaggaaagattgattcagaatctcctcatatttgattgggagctaactcaagatgaactgaagaagatggcatcaattcaacagtctagaatagccatagcccctgagtttgtgttccctggcagccctttcaaatcctttgaagagttctgggatggagaaatgtga

SEQ ID NO: 55 - DNA, 966 bp, Tinospora cordifolia
atgggaattagcatgcctgacgcaacccttaattccggccatcggattcctctcatcggattcggaaccgcgagtttccccttccctcttgaaggatcagaaactgctacacgggcaatactggaagccatcaagattggttaccggcactttgacacggctgccttgtaccagacagaggttggacttggtgaagcaatagaagaagctcttcatcttggtctcatcgagtcccgtgatgagctcttcattacctccaagctttggtgcactcatggccgccctgagcgcgtccttcctgcaattcgagaatctcttaagaatctgaagctggactaccttgatctttatctgatacacatgccaatgagcttcaagtcagaaaagccatggttcccattacctggagagtttgaagccatggatttcaagtctgtatgggaacagatggaagcatgccagaggcttggccttgcaagatccattggagttagcaacttctcctgcaaaaagctccaactcatcctcactactgcaaatattcctcctgctgtgaatcaagtggagatgaacgccctttggcaacagaataagctgagagagttttgcaagagtgaaggcattgttatcactgcttactctcccttgggaggcaaaggaaccagttggggttcaaatagagttatggaatgtgaagtgataaaagagattgccacggaaaaaggaaaaacacacgctcaggtttgtcttagatggctgtacgagcaaggcgtgagcatggtggtgaagagcttcaacaaagagagaatgaaagagaacttggagatattcgactgggagctcacaagtaaagagtgtgagcagatcaagaagctaccgcaaagcagaggatttactgcacaagggttggtctcagaagatgggcctttcaagtctatagaagatatatgggatggagagatttga

SEQ ID NO: 56 - DNA, 1002 bp, Thalictrum flavum
atgaggaggccacacagcagactagctagtactagagatatgagtagtattgttcctgatgtggttcttagctctggccataaaatgcctcttattggcttcggcacagttgcgtatcctatcgcagcatcagactccataaagacagctatagtcaatggaattaagcatggttacagacactttgatactgcttcagtttaccaaacagaacaactacttggtgaagctatagctgaagcacttcaatttggtcttattaaatctagacaagaacttttcataacttctaagctatggtgcagtgattctcatcatgatcgtgttctccctgctctgcagaatactctcaagactcttcagctagattaccttgatctgtatctcgtacattggccaataagctctaaaccagggaagcacgagttcccaataccgaaagaggaacttcttcccctgcattttgagtctgtatggacagccatggaagagtgtcaggctgttggccttacaaaatcgattggtgtcagtaacttttcttccaagaagcttgagcagctactctccacttccaagattccacctgcggttaatcaagtggagatgaatccaatttggcaacaatataagttgcgagagttttgtaaatccaaaggtatagttattactgccttttctccattgggtgccaaaggaacgtcttggggaactaataaagttatggactcggaggtgttgaatgagattgctcaggctaaaggaaagactcatgctcaggtttgtcttcgatggttgcatgaacaaggcatatgtgtggtagtgaaaagcttcaatgaagaaaggatgaaggagaacctggagatattcgactgggaattgagcccagaggagtccgcattaatccagcaattaccgcagagtagaggaaatactggagaggactttatctcagtcgacgggccattcaagtccttagaagagctatgggatggagagatttga

SEQ ID NO: 57 - DNA, 963 bp, Thalictrum flavum
atgggaagtatacctgaggtaagcttaaactccggtcaccggatgccactcataggcatgggcacagcatcatacccttttgcaggatcagaagtagtaaagtcagctatactcagtgcaatcaaacttggtaacagacactttgacactgctgctttatacaaaacagagcaaattattggagaagctatagctgaagcacttcaacttggtcttatcaaatctagagaagagcttttcattactaccaagctatgggtgaatgatggtcacaaagattgcatcctccctgctcttcaaacatctctcaaaaacctgcagctggactacgttgatctatatcttatacattggccagtatgcatcccaccaggggagttgcgaatgcctggaccaaatgaaaaggttcttcccatagattatgcatctgtatgggaagcaatggaagagtgtcaaaggcatggccttacaaaatcaattggagtcagcaatttcacctgtaagaaacttgaattgatactggcctcagcaaagatcccaccggctgttaatcaggtggaggtgaatccactatggagacaagaaaaagtgataaggttttgcaaggacagaggcattgctgtcacagcttactctcctttgggcactgctggatcagattttatgggcaacagaaacgtggtgcaaagtgagttactgaaagagattgccaaagctacaggaaagacgcatgctcaggtttgtataagatgggtttttgagcaaggagtaggggtaatagttaagagcttcaaggagatgagactggaggagaacattgacatatttgattgggaactaagcaaagaagactctctgaaaattagccgattaccagagagtaaaggctatcccggacatggcttcattagagttgaagggccattcaaatctcttgaggagctttgggatggagagatctga

SEQ ID NO: 58 - DNA, 963 bp, Xanthoriza simplicissima
atgggtagtgttccagagataaccttgaactccggccacagtatgcctgtcttaggcttgggtaccgcatctgttccctttgctggatatgaagtagtgaagtcagcgatactcagtgcgattaagcttggttatagacactttgatacagcagcgttatacagaacagagcagcctctaggagatgctatagctgaagcaattcgccttggcatcatcaaatccagagaagagctttttattacctccagaccatggctcaatgatactcaccacgatcgaatcctccccgctcttcagacgactctccaaaatctccaactggattaccttgatctttatcttatacattggccactgagcataaaaccagggaatatacgattccctggaccagacgaaaagattcttccaatggatttcgagtctgtatgggcagccatggaagagtgccaaaggcttggtctcacaaggtcgattggagtcagtaatttctcctgcaagaaacttgagaagattcttgcctcagcaacgatccctcctgctgttaatcaagtggaggtgaacccactatggcgacaagagaaactgatacagttttgcaagtctaaaggtattgttataacagcttattctcctttgggaactgttggttcaagttttcaaggtaacaacaatatcatggaatgtgaggttctgaaagagattgcagggaacagaggaaagactcatgctcaggtttgtcttagatgggtatatgagcaaggggtttgtttgctggtaaagagcttcaatgaggcgaggctgaaggaaaacatggaaatatttggctgggcattgagtgaggaagaagcaaaccagatcaatcagctgccacagggtagaggatatcctggacataatttcattacgcctgatgggcctttcaaatctgaagaggagctttgggatggagagatataa

SEQ ID NO: 59 - DNA, 1150 bp, Argemone mexicana
acttcaaaatatgaatattcatcgatcaaacaaaaaccctaaagtttaatggcagaaaataattcttccattattactacaaatgtaactaatccctacgaatatctcaagatcgttcacaactcagaagacgatacactcactcggctcgatcctgtcccaattacaaacccaataacaaacgttcaaaactgcaaagatattcctctcaacattcaacacaaaacctggattagactcttcaaaccacctcaattacaacaacaaaaatcttcgaagaaagacgatgaattttctaaatcgttatcaaataaccaaagttttcctctaataatttacttccatggaggtgggtttataatgaatagtgcagcctcaaattatgaacatgttttttgtgaatttgtgacgactcgtatacccgcttttatcgcttcagttgaatatcgtcttgctccggaaaaccgactcccagcggcttatgatgatgcagttgaagccctaaattgggttaaaaaccaagccttggatacgattaatggtgagcaatggttgagaaattttgttgatttttctaaatgtttcattatggggtgtagcgcaggtggaaatattgcttatcatgcttgtttaagaacattagaattggatttggaaccaataaagatttctggtttcatattgaaccaaccttattttggtgggttaaggagaactgaatcagaattgagattgattaacaattggatgttgccgttagttatcaatgatttgatgtgggaattaagtttaccgattggtgcgaatcgagatcatgtttattgtaatccaatggttgatattgataattcatcatcaacaatattaggattagttaaaaaattagggttaataaggatgaagtgtttggttatagggtgtgatggagatccattgattgatcgtcagattgaatttgtgaagttgttgaaagagaaaggtgtaatggttgagagttgcattgaagaaggaggttttcatggggtgggtttttcttgtcctgaaaaaactgatgaattgtgtgtaaaattaaaagattttattttaggtacctattaatgtttgtatcagctcaaatctcaatcattgatttgaatctaaaattattttc

SEQ ID NO: 60 - DNA, 1089 bp, Berberis thunbergii
tatcattagcataaagcattccaaaagtaggaaatataatcacataatgatcctcttattcactcaatagacactttttatataaaaactggaaactcacagcggtcttactcagtagcttcagaggagtagacaaaatctatcaaggcagcaaacaatacctcagctttctgtggttcatacagttcaataccatggtacccttctttttcattgtcatcaaaccaacgcacaacatgcacacctttcctctccaacatcctcacaaactccatctgatgatccatcagtgggtccccactacgcacactcacaaaacaacgcttaattaatccattcttcttgtcatcatcaccatggatcattggattgcagtacttgtgatcacgatcaacccttcttggcaaagccaactcccacatcatatcactcattgataatggcaagatcttatcatcgaccaacctcagctctgatttagtcctttgagtcccaccaaaaaatggttgatttaatacgagccctctgatcttcaggggctcaatatccaaatctaatgcctgcagacctgcatggtacacaatgtttcccccagaactacatcccatcagaaaacatttggaaaagtcgccaaactccctcaacaatggctcaccatttaaattcaaagcttgatctctcacccaattaatagcttgcactgcatcattgtaggctgcagggagtcgactttcgggtgctagacggtactcaacagagagaataaaagcaggtagtttattagctaaggatgtacagaagtcatgaaaaatggtttgggctgcactgcacaaaatgaatccacctccatgaaaataaagtataattgggagcttatcaccattagtaattcgtggtgattcaatgggtttgaaaagcctcaaccaagttttatgagcagtgtttaggggtatgtcttggatgatagattgatcatcctcatatctacaagtaggggatatgagtctagtgagtgtatcgtccgaattgtgaacaaggccgagaaggttgtaagggtttatgggtgtttgggactgagattgatctaca

SEQ ID NO: 61 - DNA, 965 bp, Chelidonium majus
cgacttataaaagagagcagaaagaaagcaaaaaaaatgaaaaatccggtaaaacgaaaaattacatcagctagttcgtacacaatgtttcgtccaaaagctcattttagaaaaaataagaatttcattgtttaatactaataatatattttagtatataaattcgtcgtttaaaataaaatgttttagtttttccaaaaaggtttcacgtatcatagggtcaaagcatagcaccccatgataccctccttgttcaatccaagtttcaaccttcacacctttttcctccagcatcttcaccagctgaatttgtcgatcaataagtggatccccataaaatcctaccacaaaacatctctcgattaaccccaccatatttccagatgatgatccatcatgatcaatattcggattacaataaacgtgatcacgagtagacccaagcggcaacgccagttcccacatgacatcccttacggcaagcggcaagtcctgattgttgatcacttttgaatctgattcagttctctcaagactaccaaaaaaagggcagtgtaatattaatccattaatcttagctggttcaagatccatttctattgctcttaaactggcatgatatgcaacattagcacctgagctgcaccccataatgaaacactttgagaagtcaccatactcttttaaccatacttcactattatttagtttgcctaaaccttggtctttgacccagtttaaagcatcaacagcatcatcataggcagcgggaagtcggttttcaggagcaagacggtagtctacagaaacgaccagcgcgggtatatgtgtagcaatcgattgacaaaagtcatggttcatagttgaatctgcattgaaaagaatgaaacctccaccatggaaataaattatgataggaagcagcttattctttgttacaggaggttctttggttggtggccgaa

SEQ ID NO: 62 - DNA, 1420 bp, Cissampelos mucronata
gaaacatcaaaggcatcaaggatgccacgtgttctcagctcaagctcataataaaagccgcggccacctcgcaaaacggacgcgacgggcgcacacccaaacacacatcgccacatccgcctacaagttggccgtgccttcctcgagatgcgtttcgtagctctcggcgtaaaagacgcgactcgaggtgtgccagtccgcatcagtggtgtccgcagagcatttctgttccattaaagtaggtctctggcgtagctatgcatcaccatagtgggtggactggatgatgacaataaatgctgaactcattcgattccgatcgccaaccaacacagcccaaatcgaaacccaaattcgctctccaattctccatcaatggatccctacaagttcctcagcatctctcccaacccagacggatccctcactcgccacacccgaatccccacttccccgcccaccaacaatccaacagtggcctctgcagatttccctctcaacccctcgaacaacacatggttcagactctacaagcccacaaacacccccaccagcgcaaaggtcccgatcgtgatttactttcacgaaggggggtttgtgctgttcagcgcggcgtcgcagcccttccacgactgctgcgccgccttggcgtcccaattgcaagccctagtcatgtccgtggagtaccgcctcgcgcccgagcaccgcctcccctgcgcctacgacgacgccattgatgcgattgcgtgggtcagagggcaagccctcggcgggggcaatggttggtttggggattcggttgatttctcgaggtgtttcttgatgggtagcagctctggtggcaacattgtttacaaggcggggttgatgtcattggagaagggactaattggtggtggtgctgagcatgtgaagctagtaggactaattatgaaccagcccttctttggtggggtggagaggactgattcggagctccgctacgccgacgaccggatattgccgctgcccgcgggtgatctgttgtgggaattggctttgccgacagggtctgatcgggatcatgagttttgcaatccattaaagggtgttagtggtgagattgagaggctgcctaggtgctttgtcaatgggtattgtagggaccctttgattgataggcagagacagtttgcaaagatgttggagaggaatggagtttcagtggttgagcggtttgtcgatgatgggtttcatgcttgtgagctttttgatcctgataaagctagggctttggctttggcaatcaaggatttcatttatgattgtggtgctggtggtgcaaaatcagctctgtaatgttgtggaagaaagtatatataattatagttttattggtaattagtcggcatcccaagcttggcccgtgggcaagactata

SEQ ID NO: 63 - DNA, 1381 bp, Cissampelos mucronata
tctctctctctctctctctttttccctctatataaggagcttattggattccacatttgcaccactagagctcacaaaaattacctaagaaaacactgctactagtacttttctctccacatacttccaccaatattgtatgagaaacaaaagaatggctgctctctcctttgacaatgcaagattaggtcaccaagttggccaagatcatcgccaaaagccaggagttctaatcgaagagatcgatggcctaattcgagtttacaaagacggccacgtagagcgccctccggtcgttccaaacgttgattgtatagcgtatatcgagtcgagtttgacgtgtagagacgtaattatcgataagttcaccaatgtttgggcaaggttctatgttcctagaacccaagggacaaagcttcccttccttgtgtacttccatggtggtggcttctgcgttggctccgccgcttggagttgctaccatgaattcctaacaaaagtagcaaccaaagctggttgtgttatcatgtcggtgaattaccgcctttcgcctgagcaccgccttccgacggcctatgaagacggcgtcggcgccctcatgtgggtgagaagagagattcttagagggtctagtgaacaaaaatggtggtggagccattgcaacttctcacaagtgttcatagttggtgatagtgctggtgccaatatagctcaccatgtgaccacaagggtagggcaacttggggcttcatctgatgaacccaacattttgagccctatgactctcaagggcaccattttgattcaaccattttttgggggtgaagcaagaacgcattcagagaaatacatggcgcagcctcctaagtcagccctaaccgtggcggcatccgatgtttattggcggttgtcgctgcccttaggcgcgagccgcgatcatcgatggtgtaatcccattgcaaagggtgctatggatttggaagagttgagggtgcctccaattatggtttgcatatcagagttggacatattgaaggataggaacttggagttttgcagtgctatgaaaagggcagggaagagagtggagcatgtcgtgtacatgggtgtgggacatgcatttcaagtactaaaccactctcagctctctcaagcaagagctcatgagatgatgtctcacatcaaggctttcatcaaccgataatatatatattgttagtttttgtgttgattagttagtgtatagtaattagtatgagtacttcagtataaatatattgatcaagttcgttatatttggattgaaaattttgtgggaacgactagtatttttataatgtgttccccttgttttttcctttacaatttgctcaaaagaatt

SEQ ID NO: 64 - DNA, 1862 bp, Cocculus trilobus
aacgaataatataactaatgatattgtgtttacagagagtaagttagagagagacagagagaggattggaggatttttagagttttggtttggttagtggagaatgatgagaagttgtggagatgggagttttggggaagatcaatattgggttgttttagggtggttttttattttgttttgtgagtttgttctgtttttggaggtgattgaagcttaatggccggaagtaacgcggttaatgagtctcagagagcggttccactcaacacttggattctcatctccaattttaaagtggcatacaatcttcttcgtcgcccagacggcacttttaataggcacttggctgagtttcttgatcggaaagtgcctgctaatgtaatcccagttgaaggagttttctcctttgattgcttcatcgacagagctaccggccttcttagcagaatatatcggccagccccagctgatgaagctgaaattcttccgggcgtcattgatctcgaacgccctttaagcactgaggttgttccagtcattatcttctttcatggaggaagctttgcccactcctctgccaacagcgctatctatgataccctttgcaggcgccttgtgaggaattgcaaggctgttgtggtctctgtaaattatcgtagggcgcctgagaatcgctatccttgcgcctatgatgatgggtgggcagctctcaagtgggttcattcgaggccatggcttcggagtggagaggactccaaagttcatgtttacttggcgggtgatagctcagggggcaacattgcccaccatgtcgcaatgagggcagtggaagcaggaacagaagtaatgggtaatatactattgaatcctatgtttggtggaatggatagaacggaatcagagaagagattggatgggcggtactttgttacaattcaggaccgagattggtattggagggcttttctccccgaagggacggaccgagaccatcctgcgtgtaatccgtttggtcctaaaggcgcagacctcaaaggtgtcaagtttccaaagagccttgttgtggtggctggtctggaccttgttcaggactggcaattggcttatgttgaagggcttgagaaggctgaacaagaggtgaaactaatttatctggaaagggctacaattgggttctacttgttgcctaacaatgatcacttctacagcgtcatgaacgagataaacaagtttgtcaattctaactgttaatagacttactcttacatatgatacaggcagagagatacataacagaagcttgacatttcactcggggttattttttcctcctctttcgggttgatatcgtgtgcagtgtataagagtgtgtagtactactatgtggttgtgtcgtcgtctattatggtggaatgaggtctgcatctctgcccgactgggttcttcattctagagatgttggtttcagtttcctggttgcagagttgtgctatctttaggggacttggttcaattggttcagttggatcagaattcattcactgatgtatgtaatgtgagaacatatactggctgaacttggggctcacctggttcaatgaagctgttactgaccaccggagctgtttgacaacaggtctttttagcgcaccaaacttaggttaccctgacttctcactgcgaaaaggggaaggcaagaggagtgcggtaacgttgtggtggttattacaatcgatgcattgctaatgttacaagaactaattcagaacatggattaggaaacatccatggtattgtgacttgtatgctatacttgtcttactagaattattacataaagatgtttgcccttttaactg

SEQ ID NO: 65 - DNA, 1483 bp, Eschscholzia californica
ccacaacttctcattctaacaacttatttcaaaatcatcatcaaactcaaatatttcttcaatctttcttctttatcaacaatggaagataaatcttcatcacttatatccaatattaatccatatgaagcactacaacttgtttacgacgcacaagccgattctctcacatgtaatcttcctgttccaactatcgaatcgtcgggcgatccgaattgtaaggatatacctctcaacattgagaaaaagacatgggttcgaatttttagacccacaaccatcaccacccccacaaccaccagtgttaccactgcaacaaccaccacaaataagcttccaatcataatctactttcatggtggtgggttcatcctgtttagtgcagcctcaggtatgttccatgatttctgcaaatccatggctgcccaagtacaagctttagttgtctcagtagagtaccgcctagcacccgaaaagcgtcttccggcagcttatgatgatgcaacagatgccataaattgggttaggaatcaagccatggatcctgttaatggtgagccatggttgagagactatgctgatttctcgaagtgttttctaatgggttgtagtgctggtgctaatatttcataccatgttggtttaaaagcatgtgaattggatttggaaccaataaagatttctgggttgatactgaaccaacccttttttggtggatcaaagaggacagaatcagagattagactgagggatgatcagattttgtctaacccagtgattgatttgatgtggaaattgagtttgccaattggggtagatcaagatcatgtatatagtaatccaatggctaataatggtgggggaaatgttaaagtgataaagaggatatttgtgaatggatgtgatggagatccattatttgatcgtcaagttgagtttgtgaagatgttggaagacaagggtttaaaggttgaagcttccatggaagaaggtgggtttcatgggatgactttccttgatcccaaacaaactgattttttctgcaaaaagttgaaggatttcattttcctctcacaagttgtttaatggagattgcaacaaaaaacaaatgttgtttaatggaaagtggagcaagatcaaagggtatgtgttgattaatgtttttgtttgattaattgtaggaaaatgaattggggactccctaggacatactcccaagtatactccctctcacaagacaagatcattttagttttttcaatctgataaaaattgcgaaaagaccaaaatgacattgtcattgtgagggggagtacgcctgggagtatgcccagagagtccccctatcatcattgattgttcttataccttataaccactatgactaacataaagggtcacgtggaattgggtgaagagtcatgtaaccataaaattcttaatgacgatgttggatttgtccgccaataattagcttacgacg

SEQ ID NO: 66 - DNA, 1170 bp, Glaucium flavum
actccacccacccaaccacaaattcattttaaatctccacatgcaatcatcaagccctcaaataaaaaataccaataagactagaaagaaccccaacccaacaatggcggatcaaccacccaccacaattaatccttatgaagctctcaaaatcgttcacaatccagatgacacactcactcgtaacctccccattccagataccccttcttcagatgatccaaattgcaaagacacctctctcaaccctcaacacaaaacctggatcagaatcttcagacccactaaaacccaatctcaagataatgatttttctataacaaataagcttcctatcatagtttacttccatggtggtggattcatcctctgcagtgcattctccactatcttccatgatttctgcaaaaatatggcaacccaattaccagctttggtactctctgtggagtatcgtctcgcacccgaaagccgtctccccgccgcctacgacgacgcggtcgacgctttaaattgggttcggaaccaagctttagagactgctaatggcgaggaatggttgagggattatgcagatttctcaaactgtttcattatggggtgtagtgcaggtgggaacattgcatatcatactggtacaagagcattagaattggatctggaaccaattaagatttctgggctgatactgaaccagccttattttggtggagtagagaggactggatcggagttaagattgattaatgataaggcgttaccgcttgcaatgaatgatatgatgtgggaattgggattgccaattggggctgatcgagatcatttttattgtaatccgatggttaagattgatggtgagagtgggactagagatgaaggaaagcttgggttgaggatgataaggtgtttgacgattgcgggttatgatgacccgttgtttgaccgacagattgaacttgggaagatgttggaagggaaaggagtgaaggttgtgaggtttattgataaagaaggatatcatggaatggtgcattttgatcagaaaaaagccgaagaaatgtttgtagcagtgaaagattttatttcctctactaattaatgtgaaattggccttgttaaatgttaatggtggagccttgtgtttgaggacattttttttttttttttttt

SEQ ID NO: 67 - DNA, 1391 bp, Hydrastis canadensis
gattcttctagagttgaatgggctgaaaccccccaaatttgtctataaatagatctattgtatcctcacaaaccaattcacccattccattgattgatcagttattctccattctctaattccataaacaaataattttagtccatttttaacatggctgatcaaaattcatccgttgaacccatcgatccttacaaatttcttaatatcatttacaatccctccgatgacacactcactagaaacaaccacttcccatctacccctattacacctgatgtcaaaaacgccaaagacatctctcttaacactactaagaaaacatgggtaagactctttagacccaatgaaccatctcttaatagaaagcttcctattatagtttatagtcacggtggtggtttcattcttcagagtgcttcagatactgtgtttcacaacttttgtgcttctatggcaaatatattacctgccttagttgtttcaattgagtatcgtttagcacctgaaagtagacttccaggagcttatgaagatacaattgaagctataaattgggttaaaaaccaagcattagatatgaatggtgagcaatggttaaaagattttgctgatttttctaattgctatctcatggggagtagtgcaggtggcaacattgtgtaccatgcaggtttacgtgcgttatcattggatcttgaccctttgataatcaaaggattcatattaaattcacctttttttggtgggtccaaaaggactgaatcagaattgagattgataaatgatacgcttcttcctttagctgtgaatgatttgatgtgggagttgtcgttgccgaaagggtgtgatcgcggtcacgagtattgtaatccaatggttgatagtagttataaacaaaacattgggttgattgagaagtgttttgtgagtgtgggtggtgaggaccctttgatggaccgtgagatggaatttgtgaaaatgttgaaggagaaaggtgtgaaggttgtagtttggtttgataaggaaggattgcatgggatggaaattacagttccaggtaaagatcaagctttatttgtgctccttaaaagttttgtttattaagaaatgagaagatctttaggaactttgataccattcttgcgatcaaggcagcttgcctatggttttggtcctcttatgggaatacacatgaggggagaaggtttgatgatattgtagtgtattgagtggtgtgtgtttgtttttttttgtacatatattgagtggtgtgctttaattatttctctttgtttcctttcccatttatttgggatacttgtaataatggttcattgtcttcttcaagattattaatctgttcttcaagataatcaatctcagcccta

SEQ ID NO: 68 - DNA, 1229 bp, Hydrastis canadensis
agaaaattcaacaattttctctttttcttctcctctataaaaccatcaaatcacacaaaccagctcaatccacaatcattcacatcaaaatcaaatggcaaacccaaacccagtcaccatagatccatttaaacaactcattatcactctcaacccagatggtactctcactagacccactttagttccaattgttccaccaacaggtgaaatcaattcccattcaaaaaccccatcagttatttccatggatgtccctctaaatccttcaaaaaacacttggattagagtctttcaaccttctaatctttcttcaaattcaaaacaccctctcataatttactttcatgggggtggttttgttctttatagtgcagcatctaaaccatttcatgaatcttgttgtcaaatggctagtgaattatctgctgtgattctatcaattgaatatcttcttgctcctgaaaataaattaccctcagcttatgaagatgcagaggatgcaatgctttgggtgaagaaacaagctttgaattgtgagtataaattttgtgaatttgtagatttctctaagtgttttattatgggtagtagttctggtggtaatataacttatcaagcaggtttcagagccttgaaattagatctagaaccaattacaatcaatggggttatcatgaatcaaccattctttggtggggttgaaagaactgaatctgagttaagattgattaatgatagaattttgcctttaccaacatgtgatttgatgtgggaatttgctttgcctattggttctaatagagatcatgagtattgtaaccccattgggtcccaccataatgaaatcaaatggttaccaaggtgttatgttagagggtatggtggggacccattgattgatagacagatgaagtttgtgaaaatgttagaagatcatggagcttgtgttgtgaaacattttcttgatgatggttttcatgcttgtgagttatttgatcctaagatggctgaagctttgtatgtagatcttagagatttcatttactcttctgagtcaaatgctgttgtcaagtcaaagtattgagttgaagagatattagaaattaattagtaatttggtttggtatcatatttgattgtgactcgggagatgggatatggtttagtattgtttgtgatgctaataaaatatgagtactttgttatctctttttcaaattttttta

SEQ ID NO: 69 - DNA, 1401 bp, Hydrastis canadensis
aagccttaaacaattcaattgtgtgaattggacaaattgggaattagagatgcgaaaatgtgtagggctgagattgattatcttgaagaacagattaataatcttgaagaagacaatgaaccattattacaagtatcccaaataaatgggaaaggaaacaaagagaaataattaaagcacaccactcaatatatgtacaaaaaaaaacaaacacacaccactcaatacactacaatatcatcaaaccttctcccctcatgtgtattcccataagaggaccaaaaccataggcaagctgccttgatcgcaagaatggtatcaaagttcctaaagatcttctcatttcttaataaacaaaacttttaaggagcacaaataaagcttgatctttacctggaactgtaatttccatcccatgcaatccttccttatcaaaccaaactacaaccttcacacctttctccttcaacattttcacaaattccatctcacggtccatcaaagggtcctcaccacccacactcacaaaacacttctcaatcaacccaatgttttgtttataactactatcaaccattggattacaatactcgtgaccgcgatcacaccctttcggcaacgacaactcccacatcaaatcattcacagctaaaggaagaagcgtatcatttatcaatctcaattctgattcagtccttttggacccaccaaaaaaaggtgaatttaatatgaatcctttgattatcaaagggtcaagatccaatgataacgcacgtaaacctgcatggtacacaatgttgccacctgcactactccccatgagatagcaattagaaaaatcagcaaaatcttttaaccattgctcaccattcatatctaatgcttggtttttaacccaatttatagcttcaattgtatcttcataagctcctggaagtctactttcaggtgctaaacgatactcaattgaaacaactaaggcaggtaatatatttgccatagaagcacaaaagttgtgaaacacagtatctgaagcactctgaagaatgaaaccaccaccgtgactataaactataataggaagctttctattaagagatggttcattgggtctaaagagtcttacccatgttttcttagtagtgttaagagagatgtctttggcgtttttgacatcaggtgtaataggggtagatgggaagtggttgtttctagtgagtgtgtcatcggagggattgtaaatgatattaagaaatttgtaaggatcgatgggttcaacggatgaattttgatcagccatgttaaaaatggactaaaattatttgtttatggaattagagaatggagaataactgatcaatcaatggaatgggtcccgcgaatggggagcccgcaggccga

SEQ ID NO: 70 - DNA, 1475 bp, Jeffersonia diphylla
catttatcccaacctccaatgtcatccatctctttcattgacaaacataaaattgagcaataaaattgggaaacagtactacttatcatccaaatttaagctaaatacaaaaattaatttactttgcattctcaagagaaagttcactgaaaactgattttgtcagcactaaacacctctctccaaaatcaaccttcaagttatcttacaataccaatcacttgcaaataggccatggttcttgtgcttcttgagtcagaacacactgcaaaaaaacatttttatctcactatatctgcatagttgggacttgggacgccaaaccttcgggacagcaaaaccggactcacaaagagatcatgacacagacaacattgaattggctttctccagattttattataccttgtcactagctttattattcaataggtttatcaacactagcagcagttacaggtgaatagataaaatccttaagatccatcaccaaggcccgacccttgtctggatcaaagaactctacagcatgataagcatcagcatcatcaaagaaatgttccacaacacacaccccatgccctttcaacttctcaaccaactgtttctcacgatctactaacgggtccatttcatagccattgacatagcacgttggcaacctctgaatgtctttttggttggacccttcgaccattggattagaatattcatggtctcgatcagttccaactggtaacgcaagttcccacattaaatcggcaacgggtaatggcaagatgggatcatccacacatttcagttcggattcagttctttcaacgccaccaaaaaatggtatattaagaatcaaacctctgatctcgaccggggaaatattcaagttaagcgcgcgtaagccagcgtgataggctatattgccaccggaactactacccatgataaaacactgtgtaaaatcaacaaaggtggtgaacttgtgctcaccatgcaaggcttgttgtttcagccaaagcacagcatcaacagcatcctcgtaagctgctggtaggcgattttcgggggccagacgataatccacagagagaactaaggcaggtgtttcaccagccaagtgaacacagaaatcatgcaaggttaaagaagctgcgctaaacagcagaaaaccacctccatggaagtaaactatgatagggagctttgtgtcggaaggaagatttagggggtggaagattcggatccatgtgttggtggtggtatttagggggacatcaatggaggcaactgatgaatcgttgtagtcgtaacctgttggtggtgtggtaggtacagaagagtctagtcgagtgatagaaccgtctgggttgagaatgaagttcagagcatcatatggatccatagagaattagaatgataagaagaggatgaaacaggcgatcccttttttcttggtttggcctgttgacttcagagtt

SEQ ID NO: 71 - DNA, 1367 bp, Mahonia aquifolium
aatgccgaggcatccttcgaatcttcagcgatggctcgatcttccgctcacctgatccatgcttcaacatccctgtccacaaggatgagtctgtcctctttaaagactgtcttttcgaacccatccaccatctctaccttcgcctctacagaccttccaccatcaccaccaaggccaaacttccgatcttcttctacattcacggtggtggcttctgtatcggctcacgaacctggccaaatttccataacttctgtttttttctctctacccatctccaggctgtagttatctctcctgactatcgattagcgcctgagaatcggcttccagctgccattgatgacagctttgctgctctcaagtgggtccaagatcaagccctgttagagagctgtgacccatggttgtctgactttgcagattttagtagagttttcatatcgggtgagtcagctggtgggaatatagcgcacaatttggcggttagactaggttctggatcaccggagttggctccggtgagagttcgagggtatgtgcttttggcgcccttttttggtgggactgtgaggacgaagtctgaggcagaggggccgttggatactttcttggacttggagcttattgatagatattggaggctgtccataccagttggagacactgctgaccacccgctggtaaacccattcggaccaattagccctagtctcaaaccgaagacactcgatccaatctttgtaattgttggtggcaaggatttgcttagggatcgatgccaggattatgtaacaaaattaagagaatggggaaaattggtcgaatatgttgaattcgatggaaagcaacatgggttctttactattgatctcagttcagaagaggcaaacaagttgatgcaaattatcaaacagttcattgctgaaaatttcaaataaggatctgaagctgatagctacatttgcgacttgccgctcagtattctctttacggtgttggtgcaacagcagccagtagattggatgttaccaaagtcattgtgatggatatgggttagggtgagtagatcatgtttgggaagttctatttacaattaactgttaggaagagttactgaggacatcgttcgacttctaggagaggtactgtaaataactaaagttgtgcgataagagtgaagaattggcggaataaaggaagagaaaatggaaggaacgaagaaatgtgggaagatgaaagttcaatatctggttttgtaaaaactggtgcaagtataaagagaggaatgtaatctatgtcaacgtacatgtgcttggaaatctgactgtacatgcgttcttcatggttatttgattaatggtgtt

SEQ ID NO: 72 - DNA, 1263 bp, Menispermum canadense
tgagatctccttgaattaaataacttatatctgctcatcatcttcgactcttcataaccatggaaaaccagcagcctccgttgctcaacaccaccgatccttacgaaacactaaagatcgtctacaatgccaacgacgacaccctcactcgcctctatcccatcccctgcaccgccgcaacaggtgatcatcacaacctgcccatcatcaccaaagacatctgtctcaacaccacacacaaaacctggctgagactcttcatacccacagaaccaccaccgagtccaaacagcctccctctcataatttacttccacggcggtggcttcgtcctctgcagcgcagccaacactctcttccacgacttctgcgctcgtatcgccgccgatctcccggccgtcgtcgcctcggtcgagtaccgcctcgcgccggagagacggctgccggcggcgtacgaagacgccgtggaggctgtgaattgggtgcgggagcacgggatcaaggagaagtggacgagggattttgttgacttttcaaagtgttatcttatggggaacagttcaggagggaatatagcgtaccgtgcgggcctgcgatgtggatcgttggatctggaaccggtgaagatcgtggggctggtgttgattcagccgtattttggtggggttgagaggagtgagtcggagatgaggttggcgaatgatgggcattttccgttagtggtgaacgatctgatgtgggagttggctttgcctagaggggctgatcgcgatcacgagtattgcaatccgatggttgctggggctcagtgggagaagattgggaaatgttttgtgagcgtgcgcggtggggacccggtgatggaccgccagattgcgttagcgaggagattggaaggagagggagtgaaggtggagagttggtttgaggaggaaggatatcatgggattgagctgtttgatcctgtgaaggcatcggagttgctgctcaagttgaaacattttatttgccctcctgaagctgctgagtatagagtcgttgaaaagtagtagtcgagttggaggcgtgcgtcggtttctcgtgtgtgtgggttttgtttccaacgcattaccaaatagactcaattttcaaagctcaaattgtttttatttccttaaacttatactaattaatctttgtagcaccatgcacgcttgcacccctgttatgcacatccgagctcacatttctttttttcccatttcttaatgccttaccttcttt

SEQ ID NO: 73 - DNA, 1125 bp, Menispermum canadense
aaaccgtggctactcaagcttcaacttcaagcgccatggatgatccctacaagttcctcaacatcgtccccaacccagacggctcgctcacccgactcacccaaatccccacttcaccaccatctcatcatcctgaagccaccagcaacaaatccattaactcatcacttaatgatcactcagtcatctccatggatttctctctcaatcccgccaccaacacctggctccgtctcttccgacccaacaccactacccctcaacacgtcaagctcccaatcataatctactttcacggcggcggctttgttctcttcagcgctgcatctcaaccctttcacgactcctgcgccgccatggccgccgacctcccggctctcgtcctctccgtcgagtaccgcctcgcgcccgagcaccgtctcccggcggccttccacgacgccgtcgacgcaatcgtgtgggtcaagcaaaaggctcttgaacaacattggctctgtgatttggcagatttctccaagtgctttctcatgggcagcagctccggcggcaacatagcttaccacgccgggctgcgcgcgctgggcctggatctcgggccggttaaggtctccgggctgatcttgaaccagccgttcttcggcggggtcgtgaggacggagtcagagctgaggctggccggcgaccggatcttgccgttgcctgccggagatctgatgtgggaattggctctgccagttggatcggatcgagaccatgagtattgtaacccgattatgaaagatagtaatggcggggacattgagaggctgccgaggtgctttgttaatgggtacggtggggacccgttggtggatagacagaaggaatttgtgaagatgttggagcagtgtggagtgagtgaagtggcgcgctttgttgatgatgggtatcatgctgtggagctgtttgatcagagtaaagctaaggatctggtgatggccatcagggcttttatttacactacctctgcaactactactccaaaatcgactttgtaaaggtggaaagatcgatagataagtaattagttgcttaatttgtatgttaattatagttaaaaaggttttaagagttgtgtggtcttta

SEQ ID NO: 74 - DNA, 993 bp, Menispermum canadense
acttgtaattaagaagagtaaacgaaatccttgatctgtagaaacaattcctgaaccttacttggatcagccatctccgcaccatgaaaccctccatcttcaatcttgaccaccaccttcaccccatgtgcatccaacatcttggctaaccccttgattctatccaccagtgcgtcccctgcaaaccctcttatcagacaccttggtaaacattggatcttctgattaacaccatccaacggattagaatactcgtgatcacgatcacttccaggaggcaatgacaacacccacaacagatcactaacagccattggtaaataaggatttctgcttaatatttcttctgattgagttcgttgaatccctccaaaaaatggctgattcaatatcagccctctaatctggaccggattaatatccacatccagagctcgtaaacctgcttggtaagcaatgttaccacctgcactagtacccataatatgaacgtttgaataatcagctagctctttcatccacggatcacatccattgatttctcttgcttgatcacgaacccacatgatggcctccatggcatcatcataagcagcaggaaggcggtgttctggggcaagacgatactcaacggttatgattaaagcaggggcgaaagcagctgcacggctcaacatatcatgaaatggagctgaaatagcactcaagataacgaagccaccaccatgaaaatcaatgatgataggaagtttcttactgtggtggagagggcggaacaagcgtaggaatgtttggttgctggtgttaaggggaatgtctttggagagtgctggctgtcttcgtgacgataagttggctgattcagaggcaagttcaggcgtgggaggtactcgggggaattcgtagcctctggtgagtgaaccgtcaggattaagagcaattttgaggaactggtatggttcatcgatgaccgagggatctcttagatcggaa

SEQ ID NO: 75 - DNA, 893 bp, Nandina domestica
aatctaatccacaaatatattctaaaattataaaaaccactcatatgtagtcttgttgactcatctaccattcaacaacattcagtcattcaagtgcttctgaacggataaaattcttcaaagccacaagcaattcctcagccttttgtggttcaaacaactccatcccatggtacccttcatcatcaaaccacttcacaaccttcacatcttttttctccaacatcctcacaaactccatctggcggtccatcagtgggtccccacctctcatactcacaaaccatgaacaccctttcatcaactcaatcttctcttgatcatcatcatcatcatggaccattggattcgaatacttatgatcgcggtcaacgccttttggcaaagccaactcccacatcaaatcactcactgctaaaggtatcttctgatcattcaccaatctaagctctgactcagtcctcttggtcccaccaaaaaagggttggttcaatatcaacccttggatcttcaaaggctttatatctaaccctaatgcatgcatacctgcatggtaggccatgttgccccctgaactgcatcccatgagaaaaaacttagaaaaatcaccatattttctcaaccactcttcacctccatgcatatccaaaccttggtttcttacccaattaatggcttctatcacatcatcgtaggcagccggaagcctgctttcgggcgctagacgatactcgacggagagaatcaaggcaggtaagtttgtagccaaagatgtgcaaaaattgtggaaaaatgtattggctacgctgcagagaatgaaaccaccaccacgaaagtaaagtacaagagggagcttaagctcaccactattgctaagtgtttgttgaataggt

SEQ ID NO: 76 - DNA, 1395 bp, Nandina domestica
ggaattcgaattagcttttaaaccgaatttattgcccatatgatgttacttccttggcctattatactgtgaattacaaaaaggacttggcacaaataacattacgtaaagcgacccaaactaatctagttcgaaacattccaaattcctataatccatttcttattgtgcaccaccattgccaaaccagtccaccacttgtgccgcacacattaagcaccacgtaaaacacacagaatccaagcaaattacaagaagttacgatggtggattaacagatcaactgccatgagcaccatcaccagttgtagaagagtaaataaattccttaagatccatgtacaaggcctgagccttctcctgatcaaatagctccacagcatgacaaccatcatcgaagaaatgtgcaatgacagacaccccttgtccctccaacattttcacaaactccttctgacggtctaccaacaggtccccaccatgcccattaacatagcactttggtagcttttggatctgcacaaggtcccacacctgaaccattggactacaatactcgtgatctcgatcagccccaataggcaatgacaactcccacattgaatcagtagctagcagtggcaacaccttatcattttcatatttcatttcggatccagttctttcaaccccaccgaagaagggctgattcatgattaacccattgatcctaactggttcaagatccaagttcaatgcccgcaagccagcctgataggccatgttaccaccggaactactacccattatatagcactttgtaaagtcagcagaatcaatgaacttatgctcaccatgtaaggcttgttgtttgagccaaagcattgcatccaccgcgtcttcataagctgatgggagacgattttcaggggctaaccgatactgaactgatagaattacgacaggtagttcaccagctatctgaatgcaaaattcattcaaaggcaaaatccttgcagtgtccataacaaaaccagatcccggaaagtaaagtatgactgggagttttgtactaacggaaggaagattgagagggtggaagattcggatccatgtgttcttcatagagttcagaggaacatctatggttgcgacgttttggggtggggttgaatcagtgtaacctgttggtggtgcataaggaaatataggaggtcgggtgaacgatccatctgggttaggaatgagattgagaactttgaacggatccatggggactttcacagtttgagaattttcggtttttatacagaagttgtgttaaaaattcaacaactaggtgatccaaaggcagtcttaatgcctatgtttcccacgaagctttaccaagacgaatcttgatgatttatctaaacc

SEQ ID NO: 77 - DNA, 1177 bp, Nigella sativa
aaaaaaataaacatattaaaagaatagaaccattgtcatgcacatgtatattttgtcttcaatcttattacaactgacaatgatatttgacctctcggaacggccatcaacttacactaagagacaacaacatcaagaagaagaataaatgaattctttaaccttctcaattaactcttgacccttggttgcatcaaacagctcacaagcatgaaaaccatcatcactaaaatctttaacaacactaactccacgtccctccaacatctcaacaaactccttctgtctgtcaattagtggatccccatcatgccctcttacgtagcaccttggcaactctttgatctcctcctcttcagaacctccctcagccattggattacaatactgatgatctctatcagctccaacaggcaaacaaaattcccacatcaaatcagcaaccaccaagggaaccaccttatcatttacaaatcttaattcagacccagttctttgaatcccaccaaagaatggttgattcataataagccctttaatcttaactggttcaagatccaagactaaagcctttaaccctacatgataagtaatatttgcaccagaactacttcccatgatgaaacattttgaaagatctataaattcccaaaacttatactcacctttcatagcattattcttgacccaaagaagagcatccacagcatcatcataagcagaggggagcttattttcaggggcaagtctgtaatcaactgataagatgatggctggtaattgagtagccatttgaatacaagatacatgaaatggtcttgaagatggactgtaaagaataaatccacccccatgaaagtaaattatgaggggtagcttttgatttgaagaaagatttggtggttgaaagactctcatccatgttttgtttgaagggttgagaggaatatctaatgagattacagatttggggtcatcagatgtgggaagattgggaacttgagtgggtctagtgagtgaaccatctgggtttaggactatgttgatgactttgtatggatctagagcgactgagtttgggttttcatctgccattgtaaagatgagattctctgagatttagagggtttcttttataaagaagccgtcatttaatctcagagaatctcatctttac

SEQ ID NO: 78 - DNA, 1200 bp, Nigella sativa
cttgagcattcattagctttatttgcaaaagataaatcgaactaaacaagaaaatcaaccaaacacaacacattagatataaacgttatttgtaaaacatgggcattcataaacattatttctaaaacatgggcactcagtcacaaagttgacttgttagtttctggggaggagtagatgaaatccttaaggtcgacatacaaagcttgagccttatcagggaagaacaactcacaagcatgaaaaccatcttctaagaagtacttgataacagaagccccttcttcctctaacatcttaacaaactccttctgacgatcaatcaatggatctccaccataccctctcacaaaacaccttggtaaccttttaatctcttgattttgtgaccccttcattggattacaatactgatgatctctatcagctccaacaggcaaacaaaattcccacatcaaatcagcaaccaccaagggaaccaccttatcatttacaaatcttaattcagacccagttctttgaatcccaccaaagaatggttgattcataataagccctttaatcttaactggttcaagatccaagactaaagcctttaaccctacatgataagtaatatttgcaccagaactacttcccatgatgaaacattttgaaagatctataaattcccaaaacttatactcacctttcatagcattattcttgacccaaagaagagcatccacagcatcatcataagcagaggggagcttattttcaggggcaagtctgtaatcaactgataagatgatggctggtaattgagtagccatttgaatacaagatacatgaaatggtcttgaagatggactgtaaagaataaatccacccccatgaaagtaaattatgaggggtagcttttgatttgaagaaagatttggtggttgaaagactctcatccatgttttgtttgaagggttgagaggaatatctaatgagattacagatttggggtcatcagatgtgggaagattgggaacttgagtgggtctagtgagtgaaccatctgggtttaggactatgttgatgactttgtatggatctagagcgactgagtttgggttttcatctgccattgtaaagatgagattctctgagatttagagggtttcttttataaagaagccgtcatttaatctcagagaatctcatctttac

SEQ ID NO: 79 - DNA, 1200 bp, Nigella sativa
aaaaaaataaacatattaaaagaatagaaccattgtcatgcacatgtatattttgtcttcaatcttattacaactgacaatgatatttgacctctcggaacggccatcaacttacactaagagacaacaacatcaagaagaagaataaatgaattctttaaccttctcaattaactcttgacccttggttgcatcaaacagctcacaagcatgaaaaccatcatcactaaaatctttaacaacactaactccacgtccctccaacatctcaacaaactccttctgtctgtcaattagtggatccccatcatgccctcttacgtagcaccttggcaactctttgatctcctcctcttcagaacctccctcagccattggattacaatactgatgatctctatcagctcccacaggtaaactcaactcccacatcaaatcagtcactggtaaaggcaagatgttatcattagccaatctcaactctgacccgctcctctcaaccttaccaaagaagggttggatcatgattaatccattgatcctaaatggttcaagatttagcttcaaagcttgtaaaccaagttggtaagtgatgttaccaccagagctacttcccataataaaacacttggagaaatcaacataatcaaagaagtcgtacttatactcacccttaaaagcatgattcttgacccaaacaaccgcatccaaagcatcttcataggctgagggaagtctatcctctggagcaagactatatccaactgaaagaaccaaagcaggcaattcactggctatttgaagacagaattcactgtaaggaggagatttggcgctgaaaataaggaaaccacctccatggaagtagatgatgagagggatttttggagtcgtgggatgaatgggtggctggaaaattctaatggaagtgtttctgttgggattgagagggatatctgtgcagacaacagacttggtggtgttcaaggatagtgtactaagagggtgggggtgtctagtaagggatccattggcgttaaggactatgctgagagcttcaaatggattaattgttgagttttggttttgagctgccatgtttagattcttgaaagaggatagtataggctagaatctagattaacatcaaaggagaaccagagttattgtcaactggtcacatggctgggtaggtggttg

SEQ ID NO: 80 - DNA, 1223 bp, Nigella sativa
cttgagcattcattagctttatttgcaaaagataaatcgaactaaacaagaaaatcaaccaaacacaacacattagatataaacgttatttgtaaaacatgggcattcataaacattatttctaaaacatgggcactcagtcacaaagttgacttgttagtttctggggaggagtagatgaaatccttaaggtcgacatacaaagcttgagccttatcagggaagaacaactcacaagcatgaaaaccatcttctaagaagtacttgataacagaagccccttcttcctctaacatcttaacaaactccttctgacgatcaatcaatggatctccaccataccctctcacaaaacaccttggtaaccttttaatctcttgattttgtgaccccttcattggattacaatactgatgatctctatcagctcccacaggtaaactcaactcccacatcaaatcagtcactggtaaaggcaagatgttatcattagccaatctcaactctgacccgctcctctcaaccttaccaaagaagggttggatcatgattaatccattgatcctaaatggttcaagatttagcttcaaagcttgtaaaccaagttggtaagtgatgttaccaccagagctacttcccataataaaacacttggagaaatcaacataatcaaagaagtcgtacttatactcacccttaaaagcatgattcttgacccaaacaaccgcatccaaagcatcttcataggctgagggaagtctatcctctggagcaagactatatccaactgaaagaaccaaagcaggcaattcactggctatttgaagacagaattcactgtaaggaggagatttggcgctgaaaataaggaaaccacctccatggaagtagatgatgagagggatttttggagtcgtgggatgaatgggtggctggaaaattctaatggaagtgtttctgttgggattgagagggatatctgtgcagacaacagacttggtggtgttcaaggatagtgtactaagagggtgggggtgtctagtaagggatccattggcgttaaggactatgctgagagcttcaaatggattaattgttgagttttggttttgagctgccatgtttagattcttgaaagaggatagtataggctagaatctagattaacatcaaaggagaaccagagttattgtcaactggtcacatggctgggtaggtggttg

SEQ ID NO: 81 - DNA, 1472 bp, Nigella sativa
ctttttacttgtaaacagggtatttgctaatttttcaagccattctgtcacaaggaagaaccagagcaagatcctttaatccatggacaccttcaaacaactaagtattacctacaatccagatgatgatactatcgaccgactcgtgaccataccttgtaccaccactaaccatcacaattcccttccaaaccaacaaatcttcacccacgacattcctttgaattcttctcacaaaacatccctcagactctacaaacccattaaccctcccctccatgcaaaacttcctcttgtagttttcatccatggcggtggcttcctcttcgccagtcctttcaacactatctacaacgatttctgcacttccatggcaatttccttgggtgttgttgttctttcagtaggttatcgtcttgccccagaaagtcgcctccctgcagcctatgaagatgctttggaggcgttgacttgggtaagagatcaagctgataacattttgttgaaggacatggttgatttctccaattgttacctaatgggagatagtgctggtggtaatattgtctaccatgctggcctccgcgctttaagtataaatcttgagcctttagtaatcaaaggatacatattcattcaaccctttttcggtgggatgaagaggactgaatcagaagtgaggttagcagacgataagatcttatcatcagttgttagtgatcttctgtgggaattaggattgcccaaagggtcagatcgagatcatgagtattgcaatccaatggttggtgggggttttagtgataagattgaattgcttaccaggtgtttcctggtagcgcttggtggagacttactggtggaccgtcagaaggagtttatgaagatgttggaagaaaagggtgtggaggttgtgagctggtttgaggatgaggggtgtcacggtatgtttctttttgaaccagaaaaggctttgcatttgttcgaggtcatcaaagactttatttaccagcctatgcctactgtttgattgtaatcttctgactaggttttcttcttgctctctatggaaactctaagtctattctaagtctatatgatccctccacatatgagatttcgtgattaagttcagaaagttatttgtctactccggcgtagaaagaacaaatttaacaaggggaagagtagaagctactataaaggtagcaatgggggcgggtcgggttgtgttcgtatcgggtcttaacaggttagcggataattgaccttgtacctatatccaactcatttagttatcatgtatggtatataaaactcgtacctaactcgttaattagcgggtatacccaactatacccgtttaaacccattagtatttagtttcacattttttaattaacatgtaaagacttgtttacctatttaaccgataaaaatgtgtcaaaacttattaactttatgcccatatc

SEQ ID NO: 82 - DNA, 1102 bp, Papaver bracteatum
ccagtatagcatacatttcttgaagtaattgaataaaccaaggtgtacctgcgtttctcttataattttgaagctcctgataaaatgaagtctttgactcttggtaacatgatttcaagttcttcaggctcaaagtaaaccattccatgatacccgccttcttgcataaaagtttcaaccttgacaccttttccttccaacatcttcacaaattcaacttgtctatcaatcaatggatctccatcacacccaataaccaaacatttctttataaacccacatttctttcgtaacgattcgtcgtcttcgttgatcaaaagattacaataaggatgatttctattagacccaatcggcaaagacaattcccacatcaagtcacttaccgggagagacaaaatcttgtcattgattagtctcagttcagaactagtcctttcaattccgcccagaaatggttgattcaatataaccccggaaattttcaaagggctaagatccaattccgatgctcttaaagaaacgttgtaagcaatatttccacctgcactttctcccattatataacaatttgtaaaatcagcgtaatcccttagccacggctcacttggtttacctccggaagcttgatgtttgacccagtttagagcatcaacagcatcatcataagcagccggtaatcgactttccggtgcaagacgatactctactgaaagtactattgccggcaaagcgtttgccttggatttgcagtaatcatgatatatagtccaaaatgtgctgcaaagaatgaacccaccaccatggtaataaattatgaccggaagcttatttgctgtgggtaaatcttgaattgtgggtttgaagatacgaatccaagtattgtgttgagcattgagaagtatgtctttggaatttggatcatctgtcgtgtttgtaatttgaagtgggagatttcttgtcagggtatcaagatcaggatcgtgaacaaccattaaggcttcgtaaggatcgatggtactactagtagtagttgaatgttgatctgccatttttggatgtggattaaggtttaggggatgtgcgcttgggatggttttag

SEQ ID NO: 83 - DNA, 1878 bp, Papaver bracteatum
taaaccttaatccacatccaaaaatggcagatcaacattccatcgatccttacgaagccttaatggttgttcacgatcctgatcttgataccctgacaagaaatctcccacttcaaattacaaacacgacagatgatccaaattccaaagacatacttctcaatgctcaacacaatacttggattcgtatcttcaaacccacaattcaagatttacccacagcaaataagcttccggtcataatttattaccatggtggtgggttcattctttgcagcacattttggactatatatcatgattactgcaaatccaaggcaaacgctttgccggcaatagtactttcagtagagtatcgtcttgcaccggaaagtcgattaccggctgcttatgatgatgctgttgatgctctaaactgggtcaaacatcaagcttccggaggtaaaccaagtgagccgtggctaagggattacgctgattttacaaattgttatataatgggagaaagtgcaggtggaaatattgcttacaacgtttctttaagagcatcggaattggatcttggccctgtgaatattaccggggttatattgaatcaaccatttatgggtggaattgaaagaactagttctgaactcagactaatcaatgacaagattttgtctctcccggtaagtgacttgatgtgggaattgtctttgccgattgggtctaatagaaatcatccttattgtaatcttttgatcaacgaagacgacgaatcgttacgaaagaaatgtgggtttataaagaaatgtttggttattgggtgtgatggagatccattgattgatagacaagttgaatttgtgaagatgttggaaggaaaaggtgtcaaggttgaaacttttatgcaagaaggcgggtatcatggaatggtttactttgagcctgaagaacttgaaatcatgttaccaagagtcaaagacttcattttatcaggagcttcaaaattataagagaaacgcaggtacaccttggtttattcaattacttcaagaaatgtatgctatactggactattctgttgcgcaataagtttgcaaaatttgtccttctctctgtatcattccaatttattgcaaaaatttccaataacttctcttttctagtccattttggatttcttgccaattatgtatcctttccttgaattaggagcgtggatcttcaccttctttagtttccaaccatcagatccagataggggtaagtgccaatttaacagttgttttgtgtttttccattttttgttctttctaccgacagttgtgtatgtatgcacctcccaatatatatgagctcgttcaggcaatcacaaaccacagttcatacctttacccaatcatttatccaacaatggctaaaacaggtttcgcctgggctatcgatactgcaacaaccgatccttacgaaaaactaatgtgcatccacagtcccgaagaagatactcttgtcagaaacctcccaatcccagttacacccttagatcaaaacaccaaagacatttctttaaatcctgaacggaaaactttgattcgaatttttcgaccaccaaccgaactctctgtaacaaataagcttcctgtcataatttattttcatggtggtggtttcattcttttcagtacagcttcaactattgtccacaatttctgccaatccattgctactcatttacctgcagtagtcgtttctgtagactaccgtcttgcgccagatagccgacttccggctgcatatgatgatgctgtggatgccctcaactgggtcaaaaaccaaggtttggacaccttaaatggtgaaccatggttgaaagagtatgctgatttctcgatt

SEQ ID NO: 84 - DNA, 2521 bp, Papaver bracteatum
tgcaattttattgtatgaattccatgaccttctaggaactgccgaacatgatttatagtggcatgggatcatagatatccttgacttacagaaccttggaaaacataacaaggtttataagaaagcctcccgtagaaggagggttgtaccacgattttatcaactggctgcaagagaacattgtcagtcacactcatagttgtttcagtctttctatttctttgtctcgattagagacgatgaaacctaaaaaccatcatgtacaaattccttccatcacttgcaccaaaataacatatacacattacacactggttaatataaatcaatgttcagtcaggacgtggttcaagtgacataccatttgacccttttatgtgccaatcgtgttgcaggcaaatatatgtagcagtttggcgcactttaattcaggttataaaggcgcagagtcctaaaactttggggattccaccacccacccaaatgcaggtgcacgtctcacttcgagagaaattgcaggcccgggcagtgaaattgctgcatataataatccaaactcccatcagtcaaaattaaccctacatcagcatctcttcttcatcttaacagcgtctcttcttcatcttgtagtttcctgagcgtcttctttgcatagagtgtgataaaaactgtaacaccaactgttaagacgaatccaatggcgttgtagataatttgagatgtcgaaagatactggtgcccttgtgtggcatctgccaagcttgcaactaaaatcccactgtagattgaaacaaatatttccggcaccactcctaccagcgacccaagtatatacggacaatatttaacaccagtggcaacagaagcataattgaatatgataaatggaaaaggtgaaattctaagtaaggcgacagctcgaaattgatgaaaccaatctccttcaccagctaatcttatgatggcagctttgtctggccatttagccaaccacacctggattttatgatgaaagagagaaccaataaagaatggaattgacatgccgatgctaaacccagctagaatcagcagaaatccatatccataaccaaaactaatgccagctacccacatagaaggggaagatgggatgcacagggcagggaaaaatgtcatagaagcaaacaatatagccgccagcaccttaggactgaatgttctcatttcccagtccaagattgggacaatctccttattcaaaaggaaaggtccaacccagatgagaaaaacaacagcaacagtagcaataacaatccctaacaaacccatcttgaaccaccaacaccaattaatccctttcctaggtgataatggaggtttcaatatctcttcaacttgattatcagaacttctcagcgtcacataatcttcatctcctcgatccattttcacttttattaacaatggtgctaccacttcatccttaccatcataatatgtcatcactcttacagaaaaaaatcaatcaatttcgattaagatcccaaacccaaacgaactactcggaataatttacaacccagctactgatagtcttactagaaactctcccaatccaatcaccaattcagatgatgatccagacaccaaagacatcgagttaaaccccgaaaacaaaacctggatcagaattttcagaccatctgaatctcaacataaccatgaacaacttcttccactgatagtttactttcatggaggtgggtttatcctatgtaatgcaaattcaacgattttccataacttctgcaaatccatggcgaatcagttatcagcgatagtactctctgtagagtatcgccttgcgccagagaaccgattaccggcggcttacgaggatgcggtggaatctctagtttgggttcaaaaccaagctttggacgccataaatggagaaccatggttgagaaattatggtgatttctccaaatgtttcattatggggtgtagtgcaggaggaaatattgcgtacaattcatgtttaggagcatcagaattggatttagaaccaataaagatttgtgggttaatattgaaccaaccatattttggtggagtagaaagaagtaaatctgaattgagattggttaacgataagtgcttgccttcagttgttaatgatttgatgtgggaattaggattaccagttggggttaacagagatcatgtttattgtaatccatttgttgatgagaatttagaaacaaaattaaggtttataaggagatgtttagttacttgtagtaatgaagatcccttggttgatagggatatccagtttgtgaagatgttggaaggaaaaggtgttaaagttgtgagttggattgaggaatttgggtttcatggaatggcacattctgatccagtgaaagctcaagaattgttaaaagttgttaaagatttcattttctctgaagattgagtttactgtcatgttgtacttctattgctgcttggagtgctataataaaatggtgta

SEQ ID NO: 85 - DNA, 1133 bp, Papaver somniferum carboxylesterase 1
aataaaaatccaacaatggcagatccttatgaattcctaatgtgcattcacaatcctgaagaagataccctaacaagaaattttccgattcctgctactcccttagatcaaaacaccaaagacatttctttaaatcctgataggaaaacctcacttcgaatctttcggccaccaaccaaagaacctcctgtaacaaagaataagctgcttcctatcataatttatttccatggtggaggtttcattcttttcaatgcagattcaactatgaaccatgacttttgtcaatcgattgctacacatatacccgcgctggtcgtttctgtagactaccgtcttgctcctgaaaaccgacttcccgctgcctatgatgatgctgttgatgctttaaactgggtcaaagaccaaggtttaggcaaactaaataatagtgaagtatggttaaaagagtatggtgacttctcaaagtgtttcattatggggtgcagctcaggtgctaatgttgcatatcatgccagtttaagagcaatagaaatggatcttgaaccagctaagattaatggattaatattacactgccctttttttggtagtcttgagagaactgaatcagattcaaaagtgatcaacaatcaggacttgccgcttgccgtaagggatgtcatgtgggaactggcgttgccgcttgggtctactcgtgatcacgtttattgtaatccgaatattgatcatgatggatcatcatctggaaatatggtggggttaatcgagagatgttttgtggtaggattttatggggatccacttattgatcgacaaattcagctggtgaagatgctggaggaaaaaggtgtgaaggttgaaacttggattgaacaaggagggtatcatggggtgctatgctttgaccctatgatacgtgaaacctttttggaaaaactaaaacattttattttaaacgacgaatttatatactaaaatatattattagtattaaacaatgaaattcttattttttctaaaatgagcttttggacgaaacattgtgtacgaactagctgatgtaatttttcgttttaccggatttttcattttttttgctttctttctgctctcttttataagtcgttctt

SEQ ID NO: 86 - DNA, 576 bp, PsoCXE2 Contig17740 in Beais choice Ps-velvet
cgctgcctatgatgatgctgttgatgctttaaactgggtcaaagaccaaggtttaggcaaactaaataatagtgaagtatggttaaaagagtatggtgacttctcaaagtgttttattatggggtgcagctcaggtgctaatgttgcattttcatgccagtttaagagcaatatgccagtttaagagcaattagaaatggatcttgaaccagctaagattaatggattaatattacactgccctttttttggtagtcttgagagaactgaatcagattcaaaaagtgatcaacaatcaggacttaaagtgatcaacaatcaggacttgccgcttgccgtaagggatgtcatgtgggaactggcgttgccgcttgggtctactcgtgatcacgtttattgtaatccgaatattgatcatgatggatcatcatctggaaatatggtggggttaatcgagagatgttttgtggtaggattttatggggatccacttattgatcgacaaattcagctggtgaagatgctggaggaaaaaggtgtgaaggttgaaacttggattgaacaaggagggtattt

SEQ ID NO: 87 - DNA, 1230 bp, Sanguinaria canadensis
agatcatcatcaattatctcaactagcagcttctgttaactactccattgatccttacgatcgcctcaagatcgtccacaactcagacgatgactcactcattcgactcgttccgctcccaagttacccttcaacagatgatgatgatcaaaactcatgcaaagacatccttctcaaccctcaacacaaaacatcgatccgaattttccgaccaaccaccacacaatttcaacaatcttcgaagaagtatgatttttctgtgaaaaacaaacttcctcccataatttacttccatggcggtggatttatactcggcagtgcattcaacatagtctttcacgactactgcaaatccatggctacccaattacccgctttggtactctccgttgagtaccgtctcgctccagaaaaccgtctcccagccgcctacgacgatgcaatggacgccgtaaattgggttcgaaaccaggccttggacgccattaatggtgagccatggttgagggattatgctgatttctcaaagtgttttcttatggggtttagcgcaggtggaaacattgcatatcatgctggtctacgagcattggaattggatctggaaccaataaagatttctgggcttatattgaaccaaccttattttggtggatcaaagagaaccagatcagagctaagattgactaacgatccgattttgccatgccctatgagcgatctgatgtgggaattggctttgccacgcggcgctaatcgagaccacatgtattgtaatccgatggttgatgatgtgactcgtagaggaaatcgtaataaggtggggttggtaattaggaggtgtttgatggcggggtgtgatggggatccattgatagaccgtcagattgagtttgtgaagatgttggaaggtaagggagtaaaagttgagacttggatggaagagggaggttcccatgggatggtttttgccgatcccaaaaaagctgaaatcctgtttggaaaactaaaagacttcattttcactgatatcgttactaagggagctgcaaactgaaatcgaaaggtgtttttgttaattaagggcatgttaggtgttttagactatatgatagatagtactacactgtttaactattgtggatgaagattatggtagaattataattagattaggaaagattatgattgattgatttggaagatttttttctattttattaagatttg

SEQ ID NO: 88 - DNA, 1118 bp, Sanguinaria canadensis
attcatacttcaaaaaacaaaattcatattcaaattggaaatcggacccatacataagatgtatgattaatagcgaaagcgaatacattttattatgtttcttttcaagtccactacgcaccacacaaactttactaagctataatttgcattccacaccatttcaaaagatttgattacaatactcatgatttcgattagcccataggacacaaaatcacttgcagaagagtaaacgatcgataggtatcgacgatttagcagccccagtggtagaaacaccaacatcagttgcagaagagtagataaatttcctgacatttgttaccaaagcccgagccatctcaggatcaaacaactccacagcatgagaaccatcatcagcaaaatgtgccacaacacacaccccgttcctctccaacatcttcacaaactccttctgatgatcaaccaatggatctcgtccattcccattaataagacaccttggtaacatacgaatcttgcaataatgagacttctcaaccattggattacaatactcatgatttcgattagccccaattggcaatgcaaattcccacatcaaatcactaacaggtaatggcaagatctcatcattcgcatatcgcaattcagatccagttctttccactccaccaaagaatggctgattcaagatcaacccattgatcttaactggttcaatatccaaatccgccacccgcaaaccagcctgataggctatattaccaccagagctactacccattaaaaaacaccctgtgaactcaacaaagtcaacgaacttatgctcaccaccatttaaggcttgtttcttgagccaattaatcgcgtcaatagcatcttcataagctgatgggagacgactctctggagctaatcgatactcgacagacagaattacagcaggtaattcactagccaaacgcacgcaaaactcatggtaaggtaatgatgcagaactgaagacaatgaaaccgcccccatgaaagtaaattatgataggaagtttagaattgtttgaaggaagattggaagggaggaagattctgatccatgtgttcttgtcggtgtttagagggacatctatggaa

SEQ ID NO: 89 - DNA, 1119 bp, Stylophorum diphyllum
taagctgcataaagatttggatttcagaccaaaaaacagacatacagatttggaattttattgagttacaaatttacaatacatggagtcaatcctaagacccaacccattttatgccctaattgaatcagcttagacatcattttatgccctaatgaaatctttcactaccttaaacatttcttcagcatgtttctgatcagaatgcacctttccatgacatccttcctcttcaatccaactcacaactttcacacctttcctttccaacatcttcccaattaccaaacacctctttatcatcaaccaattaatggtgctagtcccaccattgttctcaaccatcatcggattactataaaaatgatcacgatcagccccaatcggtaaacccaattcccaaaacaaatcactcataacaatagaaatcaccttatcattaatcaatctcaactccgatccagttctctctaccccaccaaaaaaaggctggttcaaaataagcccagtaatcttaattggttccagatccaattctaatgatcttaaacaagcatgatatgcaatgttaccacctgcactctcccccataataaaacagtttgagaaatcaccatactccctcaaccattcctcactattaataacatccaaagcttggtctcgaacccaatttagtgcgtcgacggagtcgtcgtaggcggcgggaagtctgctttcgggtgcgagacggtactctactgagattaccaaagctgatgattggatcgccattgacttgcagaaatcgtggaagatagttgaggatggactgcaaatgatgaacccaccaccatgaaaataaattatgacaggaatcttcttgttttgatcatcttgaaattgggttttggtgggtctgaagattcttatccaagttttgtgttgagggttgagagggatatctttgcagtttggatcatctgatgaaggggtatctgggatggggagattacgggttagtgtgtcatctggattgtgaacgatattgagagcttcataaggattaatggtggtggatgattgatccgccattgttagaggcttatagctaggtgggtttattggtggaagagattc

SEQ ID NO: 90 - DNA, 1251 bp, Tinospora cordifolia
atgctagacagtagcacgagaacagcaaattgtatatgtgtaagcaataataacaaggtctaagtacctcatttttcgtaaataaaatgtttgatttttaccagcaactcggaagccttctcacaatccgatagctcgaccccatgatacccttcttcctcaaaccaacactttaccttccctcccttttcctctatcatcttcacaagttccatctgcctgtccctcaacatgtctccgccacgtacacataccaaaaacctccccaactgtccgatcttctccccataatcaccaaccatcggattacaatactcatgatcacggtcagctgctttcggcaacgacaactcccacatgacgtcagtcatgcccacagtaaaattttcatcgtttcccagtctcatctctgatgcagttctttgtaccccaccgaaatacggctgaatcaatattatccctacgatcttcaacggatccagatctaaatgtaggcttcgcaagctcgcatgatacgcgatgttgcctcccgcactcaaccccatcagataacacgtgggaaagtcaacctgttctctcagccatacgtcctccagatcatgacccttatcatcacctgcaaccagcgcctgttctcgaacccagtggatggcgtcgacggcgtcatcgtaggccgccggaagccggctttcgggggcaagacggtactccacggagagaacgacggcgggtagctcgacggcgacgcgagagcagaagtcgtggaacatagtgttggctgcactcatgaagatgaagccgccgccgtggaagtatattatgagaggtagcttctttgatggcggtgggccggtcggcaggaagagccgcagccaagtgtgatagctggagttaagaggaaggtctttggtgagaacgggttggctggagactgccggagagtggtggtgatcgtcgtcggtgttggttgggttggtgcagggtacggtgaagagacgagtgagggtgtcggtttctgggttgtagatgatcttcaaggatttaaaaaagtcggttgggttgattgatgggacatcatcatgatcttccatgtttcgaagaggaaaagatgctgaagaatcagaaacagagaattctcagacaactccaactcttgaacaatagaattatatgttccagtgccatgacaacgcaacaaacttgacctttagttgctagacatcaatcttttgttgctaaaactttttagca

SEQ ID NO: 91 - DNA, 1251 bp, Tinospora cordifolia
atgctagacagtagcacgagaacagcaaattgtatatgtgtaagcaataataacaaggtctaagtacctcatttttcgtaaataaaatgtttgatttttaccagcaactcggaagccttctcacaatccgatagctcgaccccatgatacccttcttcctcaaaccaacactttaccttccctcccttttcctctatcatcttcacaagttccatctgcctgtccctcaacatgtctccgccacgtacacataccaaaaacctccccaactgtccgatcttctccccataatcaccaaccatcggattacaatactcatgatcacggtcagctcctttcggcaacgcgtactcccacatcgcgtcactcatgtccaacgtaaacattccatcattccccaatctcatctccgacccacttctctgtaccccactaaaaaatggttgaatcaataccatccctacgatcttcaccggctccagatctagcggtaagcatcgcaagctcgcatggtatgcgatgttgcctcctgcacttaaccccatgagataacacgtggaaaagtcaacgtattctctcagccatacgttcttaagatcgtgagccttatcatcacccacaaccagcgcctgctcccgaacccagtagatggcgtcgatggcgtcgtcgtaggccgccggaagccggctttcaggggcaagccggtagtctacagaaatgacgacggccggtagctcgacggcgacgcgagagcagaagtcgtggaacatagtgttggctgcgctcaggaagacgaagccgccgccgtggaagtatattatgagaggtagcttctttgatggcggtgggccggtcggcaggaagagccgcagccaagtgtgatagctggagttaagaggaaggtctttggtgagaacgggttggctggagactgccggagagtggtggtgatcgtcgtcggtgttggttgggttggtgcagggtacggtgaagagacgagtgagggtgtcggtttctgggttgtagatgatcttcaaggatttaaaaaagtcggttgggttgattgatgggacatcatcatgatcttccatgtttcgaagaggaaaagatgctgaagaatcagaaacagagaattctcagacaactccaactcttgaacaatagaattatatgttccagtgccatgacaacgcaacaaacttgacctttagttgctagacatcaatcttttgttgctaaaactttttagca

SEQ ID NO: 92 - DNA, 1357 bp, Tinospora cordifolia
ccgattcaattgctagaatatgacgattagatactccacaatttttaatttacacattcactttcacagactcgaaggaaaaattaatacgtaaataggaaatacatatcctaactatgtattttcttactcactaaatgttgagaatatgaaatcctttaaggctacaagcagtgaatccaatttatgggaattatttaagagttcctcgccatgatgatctccttcaacgattctacccttcacttttacacctttttctttcatcgtcgtcaacaatccaatctgacgatcaattccgggatccttatctccagtagacatcagtatcttccaacccaacattttgatcttgtcgaatagttttgacctatccactaccgctggattagaatactcatgatcacgattagctccagccggcaaagagtacttccacatcacatcagttgcaataagaggcagaatgaggtcgtttgccattcttaactcagattcagttctttcatgcccaccaaaaaagggataatgcaatatcaatccattgatcttcaacggcttaaaactgtcaacatcttccattgccacacgtaaaccgacatggtacgctatgttccctccagcgctgcaacccatgatgaagcaattagaaagattagcatggtctctcaaccaagaatcctccgcgaattttatccagttcaaagcttcgactgcatcatcgtacgctgccggcaggagatgctcgggtccaacacggtagtcaatagagacaacaacagcagatagttgtaaagcgagtttggagcaaaagttataacatgtgggtgtggccgtagtggagataacaaaccctccaccagggtagtatacgatgagagggagtagatcattcgtggagttagactcgagcttatatcgagaaatatatacacgagcccaagtattgtttgattggttgatcgggatatctttggagagaaccggagcggggtagctcagatcaggtacggttggcacagtcggaaaattgctgggtttttttcttgtgattgtgccgtcatggtggtgtacgagatcgacgtagtcgtagggatcggtgattggaacaggggtgaaaggcgctacttgatcggacatgatgagaaatgttcaacagaggtacttgatcatctcttatcttcctacggtgtgtaaattagcatatatggagaggcaagactgcaatttaatttaatgcttggtagggttgggcaattaatttggtgttttcacaagtcgccgtcgatcgagactaattgctactaaaggaagatattttttgtatggctgatagctatctcctccctaacctcct

SEQ ID NO: 93 - DNA, 1688 bp, Thalictrum flavum
atgaacaaaacttaatatgtagacatcttatatatatattatatattatattctaaaacaaagtataagatacaagatcacactaacatggatgtttccccatcctgttttgacactacactactacgacccataacccattacattaaccgtaaaccctatactaaagacttctcagttcatggccaaaagttggagagggtaacctacagaggactgccaacctgttatcaaactgctcttgccgtgagtaacagactcccaaagcggggcttctaagtccagacaactgggctcattacacaaacaacgaaagaatgagttcagctcgaaccgtccaactgaactcattggattaagtctttcctaataagatatacttttctgcatccaggattctaaatacttgctattgctacacgaagaacaatcaccaaggatgcagaccttataacccttagtaccatagacaattaagttaagtaataagtctactacacacccttatggccttgtacactgcacactgctgcctcttaagaacaaaataaacccgtgtgaaatgtcatcaaacttctgttatgtatggctgcttgtatgtaaagtaagtctattgacagttagcaactcaggaagttgtttatctcatccatgaggctgaagaagtgaatgttattcggcaacaagtagaacccaatggtggcttgttccagaaacatcaatttgacatcttgcccagccctctggagtccttggacgtaagccaattgccaatcgtggagtaggtccaaccctgcaactacaacgaggcttttagggaacttaacaccttcaaggcttgcagcattgggaccaaacggattacatgcaggatgtgttctgtctgctccttgagggagaaaagccctccagtaccaatctcggtcttggagggtcacgaagtatttcccatctaatttcttctccgattcttcgttctaccccaccaaacatgggattaagtagtatattccccagtacctcggtcccggattctactgctctcagtgcaacatgatgggcaatattacccccagaactatctccggcaaggtacacatgagcctttgagtccttcccactccgcagccatggccttgaatgaacccatttaagtgctgcctggccatcatcataagcacatggataccggtattcaggtgcacgtcgataatttacagagaccacaacagctttgctgttgcgcacaagacgacggcatagtgtgtcatagatagcactattagcagaagagtgagcaaagcttcctccatggaagaaaattataactggaacaactacatcactgcttaagggctgttcaagctgaaggaagcttggtcgaccttcagtcgccaaggcctgtcgataaactctgcaaaggagatcagtagccctgtcgatgattacatcgaacgagaaaaccccatcaactgggttcgcattggaaggaactttccgatcaaggaactctgccagatgacgattgaaggtcccatcgggacgacgaagcatggtgtatgccagcttgaaattggagatgagaacccatgtgtttaaaggaaccgccaactaatcacacatcaagaaaatcaataataagtttcaattacaagatcaaaacttcaaattaagaaatttatagtcct

SEQ ID NO: 94 - DNA, 1227 bp, Xanthoriza simplicissima
atttttttcccactactataaatatcactatatacattgaagcaaggtgagaaaataaaaacatttcatagatattcttctaacacagttttcttatccatattccggtaacatggcagaacagaatccatccattttacctataaatccttatgaagtactaggtattgtccacaaccccgacgacacgctaactcgacaaatccaaatcccatgcactactacttctacagatgatatttcctgtgccaaaatcaccaaagacatccctctcaacgcttgtaacaaaacatggctaagattgtttaggccaattgaacaacctgttaacgtaaaacttcctattatactttacttccgtggtggtggtttcatactgtgtagtgcttccaatactatttttcataatttctgtgcttccatggcaaataaatttccagccttaattgtttcagttgattaccgcttagcgcctgaaagccgccttccatcagcctatgaagacgcaattgaagcaatcacttgggttaaaaaacaagccttagatacgaatggtgagcaatggttcaaagacttggctgatttttccaagtgttatcttatgggatgtagctcaggaggcaacattgtgtaccatgtaggtttacgcgctatatctttggatcttaagcctttgttaatcaaaggacttatattgaatcaaccttttttcggagggttgagaaggacagagtctgaaatgaggatggtgaatgacaaaaccttgcctttggttgtgagtgatttgatgtgggaattggctttgccagcaggatctgatcgcgatcatgagtattgtaatccaagggttgatggaggttttaaagaaaatatcaaattgctttcgagatgttttgtgagtgtgcgcggtggagaccctttgatggaccatcagaaggagtttgtgaaaatggtggaggaggaaggtgtgaaggttgtgaactggtttgatgaagcagggtaccatggaatggaactctttgaaccacaaaaagctgaggccatgtttgtggctctcaaagcttttatttattcttctagtgatattgaatagatgtctttgctggtgatagaagctgcaacgttgaatggttttaagttacaaagactcgagtgattttctttaatacaatgatattgaatgtagatcttataggtaagtaacatatttggaaaatcaatgcaaag

SEQ ID NO: 95 - DNA, 1246 bp, Xanthoriza simplicissima
accatcgatataatacgcgctcacaaaaaggctgtataacataatcaccagttcaccactagtattttcattatcttcaacacaacgtcatctctgtatacaatatcaataacatggcaagtcaagcagatcaagcacacgttgatcgatacaaagaacacaacatcatctacaatccagatgacactctcactagactcatcactttcccttgtactagtacaacagatcacaattcccttccaaatcaacctgtttttacccaagacatccctctcaacccaattaataaaacctggatgagactcttcaaacccagtaatccacaacctcctaaaacaaaactccctctaatactttatttccatggtagtggcttcataatcggtagtgcttctaattccacgttccatgacttttgcacttcaatggcaattgaactatcttgtgtcgtcctctcattaggataccgtcttgccccagaaagtcgactcccagctgcttatgaagacgcgatggaagcaatagattgggttcgaaacaaagcactagatttgggcagtgataattgtttgaaggaagtcgttgacttctcaaaatgctatctcatgggcattagttcaggtggaaacatggtgtatcatgcaggtctgcgcgtgttgtcaatggatcttcatcctatgattataaaaggattgatattgaaccatccattttttggcgggttgaaaaggactaattcagaattgagattggctaacgataagttctcattagcttttaccgatataatgtgggagttatcgttgccaaaagtgttcgaccgcgatcatgagtactgcaatccaatggttgaagggagtaacaaggataagattggattgcttggaaggtgttttgtgagtgggtgtggtggggatattttgatagaccgtcagatggagtttgctaagatgttggaggaaaaaggtgcgagtgttgtgacatggtttgaggaagaagggtgccatggagtggagctttttgaaccagagaaaacaagggccttgttttttcttctgaaagaatttatatctggtcagtaatttttgttctctagcatgctacaaaatgagaagcatttgagtgtactgaaaaaataaattgctcctgttttcgtttgtatattcaaataaggattaaccatatcccattctccattggcggagaatttttttttatatttatgaactaatataattttatg

SEQ ID NO: 96 - DNA, 1274 bp, Xanthoriza simplicissima
gattcaattaagtcagcaaaaagcttccacagaatcctcatttccgttcctctttaaaactatcaaaatcacacaataccttctcaatcacactatcatagattcataacaacccaagatctaacaatcatggcagatcaaaatacaattatagatccatacaaacatatcaatgtagttcttaaccctgatggcacacttactagaccaactctagttccaatcatcccaccatcaagtgatcccaattccaactctgttatctccctagacattcctctaaatccctctaaaagcacttggatgagagtttttcaaccccccaatctttcttgcaatcaaaaactacctctcatcatttatttccatggtggtggttttgttctttatagtgcatcatctagaccattccatgaatcttgtgttaaaatggctagtgaattaccagctataattatttcagttgattatagtcttgcacctgaaaacaaacttccttctgcttatgaagatggtatggaagcattgctttgggtcaacaaccaggctataaatggtgagtttgagttctgtaaatttgtagatttttccaagtgttttatcatgggaagcagtagtggtgctaatattacttatcaagtgggtttaagagccttaaagttagatcttgaaccagttaagattattgggcttatcatgaaccaaccattttttggtgggattcaaagaactggttctgaattaagaatggtgaatgatagaataattcctctagtagttgctgatttgatgtgggaattagctttgcctattggtgctgataaggatcacgagtattgtaacccaatggcggcccattttaatgagatcaaacagttgccaaggtgttttgtgaatgggtatggtggtgatccgctggttgatcgtcagaaagaatttgccaagatgttaggggagcatggggcttgtcttgtggaacattattctgatgatggttttcatgcttgtgaattgtttatccctgataaggctcaggctttggtgatgaacattagagatttcatttactctcctggtattggctccaacgctgctacgtcaactttgtgagtttttgccttttggggatatgactatgagaacttacctttgcatcttctattgtatgtgcttaataattggtatgacgaaacaaatgatatgctttttggtttttatagggtaggagtttcgggaaaaacttatattatcccctctctcgttttctttttatc

SEQ ID NO: 97 - DNA, 1476 bp, Agremone mexicana
atggatattctttcaatttcagtaatagcaatagtgatcacttctttactatacctaattttgagagattcaagtcctaaagatttaccaccaggtccaaaaccatggccaatagttggaaatcttctacaactaggtgaaaaaccccattcacaatttgcccaacttgctaaaacctatggagatctgtttacacttagattaggtactgaaacagttgttgtagcttcaaccccattagcagctaatgaaatccttaaaacccatgatagaattctatctggtagatatgtttttcaaagttttagggttaaacatcatgtggaaaactcaattgtttggtctgaatgtaatgatacatggaaaaatttaagaaaaatttgtagaacagaactttttacacaaaaaatgattgaaaatcaagctgaagttagagagagaaaaacttgggaaatgattgaatttttgaagaaaaaagaaggagaagaagtgaaaattgttgaaataatttttggaacattagtgaatatatttgggaatttgatattttcaaaaaatatttttgaattaggtgatgaaaatagtggaagtgtagaaatgaaaaaacatttatggaggatgttagaattaggtaattcaacaaatccagctgattattttccatttttgggtagatttgatttgtttggacagagaaaagatgttgcagattgtcttcaagggatttatgatgtttggggtgttattcttaaagaacgtaaagtagaaaagaaaaaaagaattgatgaagaagaaaaaaagaagaatgattttgttgatattttgcttgattctggacttgatgatcaacagattaattccttgcttatggaattatttggtgctggaacagagacaagtgcatcaacattggaatggggaatagcagagctcacaaaaaaccctaaaataaaaaccaagattcgatcagagttgatgactgtagtgggacaaaacacagttaaagaatcagatatacctaatcttccttatcttcaagcttttgttaaagaaactctacgacttcacccaccaactccattgctgctcccacgtcgagcacttgacacgtgtagagtactgaattacacgatcccaaaagagtgtcagatcatggttaatgcgtggggtataggacgtgatccaaaaacttggaatgatccattgactttttcaccagagaggttcatgaattcaaacattgacttcaaaggaaatgattttgagttaataccatttggtggtggtagaaggatatgcccaggtgtgcccttagcaactcagtttattagtcttattatagctactttggtacaaaatttagattgggagctaccaatgggaatggatcctagtgatttgatcatggaagagaaatttgggttgacacttcagaaggaaccacctctatttattgttcctaaatttagggtttga

SEQ ID NO: 98 - DNA, 1332 bp, Berberis thunbergii
atgagcaaaaacagtccacctttcttagactacatgtctaacatagcacaaaaatatggccccctagtccatctcaaatttggcctccattcttccatttttgcttccaccaaagaagccgccatggaagtcctgcaaacaaacgataaagctttatcggggcgaaaaccacttccttgctttcgcatcaaaccccacatcgattactccatagtatggtcagatagcaactcttactggaaaaatggacgaaaaatattgcacacggaaattttttcacaaaaaatgttacaagcccaggagaaaaacagggagagggtggcggaaaatttggtgaatttcattatgacaaaagtggggaatgtggtggaattgagatcctggttgtttggttgcgctctcaacgtgttgggccatgttgtgttttctaaggatgtatttgaatacagtgatcaaagcgacgaagttgggatggataaactcatacatggaatgattatgacgggaggtgattttgatgtggccagctactttccttttttagcgaggtttgatatacatggtttgaaacgtaaaatggatgaacaatttaagcttttgatcaaagtttgggaaggtgaagttcttgctaggcgggctaaccggaatccagagcctaaagacatgttggatgttctcattgccaatgacttcaatgaacatcaaatcaatgcaatgttcttggaaacatttggtccaggttcagacactagcagtgccataatagagtgggcattagcacagctgataaagaatccagacaaattggctaagctacgtgaagaattggatagggtagtagggaggtcatccacagtgaaggaatcacacttctctgaactgccttacctacaagcatgtgttaaggaaacattgcgattgtatccttcagtaacaattatgatccctcatcaatgcatggagacatgtcaagtgatgggttacacaataccaaaaggcatggacgtacatgtgaatgcccatgcaatcggaagagatcctaaagattggaaagacccactgaagtttcaacctgaacgattccttggttctgatattgaatacaatgggaaacagttccagttcataccatttggttcaggcagaaggatttgccctgggttgccccttgcggttcgaaccatcccactcgtgttggcttctcttgtgcatgcctttgattgggagcttcctgatggtgtacctaacgagaagctggatatggaagaattgttcactctgactctgtgcatggctaaacctctccaagttattccaaaagtcaggatttaa

SEQ ID NO: 99 - DNA, 1470 bp, Berberis thunbergii
atgggtcctctagcattgtttgcacttgtcttcatcataccttttctcttgcttattactctgttcaaaccatcctctaaaaaccttcctcctggaccccctgcatggcctctaataggcaccttattgcccaaactaaagaaacaaccacatgtagagctaaccaagctggccaaatcccatggtccattgatgttgctcaaattcggggtggaacccgtagtagtcgcttcaaaccacgtagctgctatggaggtgctcaagactcatgaccgtgaactatcaggtcgttttgcgccccatagtgtacgaatcaagggctatgttgaacattcaatggtgtgggctgattgcactgattactggaagttggtgaggaagatatggaggacagatatgttctctaccaaaatgttggatgcacaagcttgtgttagagaggagaaggtgttggagttggttgggtttcttaaagggaaacaaggtgaagtggtgaagtttgctgatgtggtgtttgggtgcattttgaacattttgggtgctattgttttctctcaaaatgtgtatgatttcgaagacaagtctgataatgagttggggatgaagggtatgatccggcagcttatgatattggcagcgataccaaatttagcagacctttatcctatccttggaaaatcggatttccaaggcttgaaaaaggcgtcagctgcatgtgttacgagaatgaatgagtcatgggctacagtagtcaaggaaagaagaagaaatagtgatcacctgaaaaatgattttttaaatgtgttaatcaaagctggtttcagtgaccctcaaattgacgctatgctcttggaaatatttggacctggttcagacactagtgcctccacaatagagtgggcaatggcagagctgttaaagagtcctgaaaagctaaaaaatgtacaaaatgagctcaaaaaggtcattggagctaaccaagttgtgaaagaatcagacctacccgacctcccttatctaaatgcttgtgtcaaggagaccctcagattgcaccctcctgtcacattcctactccctcaccgtgccttggaagaatgtcaagtgatgggctataccgttcctaagggatcccaattaatggtgaacacttatgcaatcggacgtgaccctgagacatggaacaatcccttgtcctttgaaccggagcgatttttatcagacacagagattgattatcaaagtagtactgatatgaagtacataccatttggggcaggaaggagaatatgtcctggattgtcattggcagctcgcctcgtgccattagtacttgcttcactcattcacgcctttgattggggcctccccggtgggatggatccgagcgagatagacatgaaggataagttcgggctggcgcttttgaaggatgatcctcttttgatcatccccaaggtcacaaaagtttaa

SEQ ID NO: 100 - DNA, 1455 bp, Berberis thunbergii
atggatctaaatactgcactcctttacttgatcccagttgttcttgtgtattatattctcttcaagcctaaacacaagaacctcccacctggtccaaaaccatggcctttgataggtaacataccagtattatttggcagcgggaagccactccatgtcaccctaactgacatggcgcgtacccacggaccaattataaccctgtggatgggaacccagccaacagccatagcttcgactgcagagtcggccatggagattctcaaaacccatgatcgtctcttctctggcagggctgtccgtatgagcttccgcttgaaacaccatatcaaatattcccttgtttgggctgactgttcggaatactggaaactcctgcgtaaaatagtcaggacagagatattttcacctaaaatgctccaggttcaggagcatgttagagaaaagaagatggaggagatggtggagtttctgaaaggcaaagagggggaggtgcttaaactcagtccattggtgtttgggacattgttgaatgtgttgggcaatgttgtgtactccaaggatgtgtttggatactttggtgatgatggagatcaaatgcagactttgatgaaagagatgctcatgattggagctgctccaaacgtggcggagttttggccaattcttgaggagttggatttacaaggcctgaaaaagaagtgtcacgaacgattcacggaagtcatgaaaatgtggaaggggactgtggaggagagaaaagttaacagaaacgcagagcctaaggacatgttggatgttcttcttgccaacgacttcaatgatgatcagatcaatgctctattcttggaaacatttggtccaggttcggagaccagcagtgcgacaattgagtggacgatggctgagctcattaaaaatccaaaaataattgccaaagttcgtgaagaattggaccaggttgttgggaaatccttggtaaaagaatcacacctgcccaaccttccctacctccaagcatgcatcaaagaaacaatgcgactgcacccagcagcacccttcctactaccccacagatcagttgaggcatgccaagtgatgggctacactattccaaaagacatacaagttctggtaaatgcttatgcaataggaagagatcctaaaacatggaaagacccaacaactttcaaaccagaaagattcatggagtctgacatagattactatggtaagcacttcgagttcataccatttggctcaggaaggagacagtgtgttggaatgcccttagcgactcgaaccattccattgattgtgtctaatctagtgcacgcaattgattggagccttcctgatggcaaaaatctagaggagttggtcatgaatgaaactttaagcttgtcactggctttagatccaactctaactgtcattccaaaagcaagggtgtag

SEQ ID NO: 101 - DNA, 1473 bp, Berberis thunbergii
atggaagaagtattgggagagagcaatctcttcttccttctcctccttgcactgctacccttttttttcttcatcttaaactacatcaaatctccaactcttccacctgggcctttttcatggcccatcataggcaatctcttgaagatgggaaccaagccccatgtctcactagctcaactagcccatacctatggcccaatcatatctctccgtctcggtactcgactcctcgtcatcggatcatctccatctgccgccatcgagattctcaaaacccatgatcgactactatctgcccggaccatacccgatgcatcacctacaaaagatccggcccatacaaaattttcgctagcatgggctgactgcaccgatcagtggaagtatttacgtactatatgtcgatcagagttattttcgatcaaggccattgaatctcaatcaaaaatgagggaggagaaggtgattgaattggtgaaatttttgggtacaaaggatggacagttggtgaggattgatgaagttgtatttgatactatggtcaatatgctgagtaatatatttgtgtcacaagattttgtcaatatggaggagagagatagtgaagaaggtttgagagggctggtgaggaaatttgtggaggtggcagcgactccaaatatagctgatttttatccaatattgagtgtattggatcttcatggtctgaaaaagaggtccaaagaattgtttgtgaagatttgtgatttatggggagttatgatcaaggaaagaagagaaggcaaaacagggaacaaagacttcttggactttttgcttgctaatggattcatcaatgatcagatcaattgtttgctattggagttgttcagtgcaggttcagatactagtacctcaacaattgaatgggcaatggcagagctgatgaaaaatgaagaagcaatgaaaaatgtcctcagtgaacttgaaagagagattcacacaaatatggtcaaagagtcggatctgcctcagctcccatacctacatgcctgcgtgaaggagacactacgactacaccctccagcgccacttctcttacctcaccgggcacttgaaacatgcaaggtcatgaactacaccattccgaaagacactcaagtattagtgaatgtatgggcaataggaagagaccccatggtttggaatgaccccttggccttcaaaccggaacggtttctagactcgaacagtctggatatgaacttgagtgattttaggttcataccctttggtgctggaaggagaatctgccctgggctgccaatggctaccaagcaagttgccttaattcttgcttctttgatcaattgcttccattggtctcttcctcatgatatgcatcccttagagctggacatggaagaaaagtttggtgtaacattgcaaaaagaacaacctctagttctcattcctagagtgaagacataa

SEQ ID NO: 102 - DNA, 1479 bp, Corydalis chelanthifolia
atggagattttgagtatagcaattctctcagttgtgatctctactttgatttactattttttcttcagtgattcaaaagctcaaaagggtcttccaccaggtccaaaaccatggccaatagtaggaaatctcctccaattaggagacaaacctcactcacagtttgctgaaatggctcagatctatggagatctcttcacacttaaaatgggtactgaaacggttgttgtagcttcaactccagcagcagcaattgaaatcctaaaaacccatgatcgacttctctcagctcgttatgtttttcaaagtttcagagttccaaaccatgttgagaactcaatggtttggtcagattgtaatgaagtttggaaaatgttgaggaaagtttgtaggactgagctttttacaccaaaaatgattgaagcccaagctcatgtgagagagtctaaagctttagagatggtgaaatttttgaaaggaaaacagggaggtgaagtgaaaattgctgaagttgtgtttgggacattagtgaatatatttgggaatttgatattttcacaagatgtgtttgagttgggtgatccaagtggtggaagtgctgagatgaaggaacatctttggaggatgttggaattggggaactctactaatccagctgattattttcctattttggggagatttgatttgtttggacagagaaaagatgtggctgagtgtttgagactgatttatgatgtttggggagttatgcttaaagagagaaaagtaaagaaagcagctcaagggaacaaaggaaatgataataaggattttgtggatgttttgcttgattctggacttaatgattttcaaatcaatgccttgcttatggaaatctttggtgctggtactgagactagttcatcaactattgaatggtccattactgagctcacaaaaaacccacatattacagccaagcttcgagcagaactggaatcagttgtgggccaaaacccagtcaaggaatcagacataccaaacctcccatacctccaagcttgtactaaagaaaccttaagacttcaccctccaaccccattgttactcccacgtcgagcgatcgaaacgtgtaaagttatgaactatacgatcccgaaagattgtcaaatcatggtgaatgcatgggcaatagggagagatccaaagatatggaaggatgctttaagtttctcacctgagaggtttttgaattcaagtgttgatttcaaagggaatgattttgagctgataccatttggtgctgggagaaggatatgcccaggggtgcccttggcaactcagtttataagtttgattgtggccacattggtacagaattttgagtggaacttaccaaatggaatggatcctaaagatttggtcatggatgagaagtttggtttgacacttcaaaaggaaccaccactttatattgttcctaaatcaagggtttga

SEQ ID NO: 103 - DNA, 1482 bp, Corydalis chelanthifolia
gaattttttagtataacaattctctcacttttgatcactagtttgatttactatcttttcagtgatcattcaaaaactcaaaagggtcttccaccaggcccaaaaccatggccaatagtaggaaatctcctacaactaggtgacaaacctcactcacaattttatgaaatggctaaaacctatggtgatcttttcacactcaaaatgggtacccaaacagttgttgtagcttcaactccagccgcagcaaccgaaatcctgaaaacccatgatcgacttctctcggctcgttatgttttccagagttttagaattccaaagcatgttgagaactcaatggtttggtctgattgcactgatgcttggaatatgttgagaaaaatttgtagaactgagatttttacaactaaaatgattgaagcccaagcctatgtgagagagtcaaaagtattagagatggtgaaatttataaagggaaaacaagggtctgaagtgaaagttcttaaagttgtgtttgagacattggtgaatgtgtttgggaatttgattttttcacaagatgtgtttcaaatgggtgatccaagtggtgaaggtgctgtgatgaagggacatatttggaggatgttggaattgggcaactctacaaatccagctgattattttcctattttggggagatttgatttgtttggacatagaaaagatgtggaagagtgtttgagacaaatttatgatgtttggggagttatgcttaaagaaagaaaagcaaagaaagctgcaattcaagaaaaaggaggaaattataataacagtgattttgtggatgttttgcttgattctggacttgaggattttcagatgaatatcttgctcatggaactctttggttctggtacagagacaagttcatcaacaatcgaatgggctatggctgagctcacaaaaagcccggatatagcagccaagcttcgagaagagctctcatccgtagtaggccaaagaccagttaaagaagcagacataccaaacctcccataccttcaagctattacaaaggaaaccttgagacttcacccatcgaccccattatgtatcccacgtcgagctcctgaaacatgtcaagttatgaaccacacgatcccgaaagattgtcagattattgtgaatgtatgggccatagggagagatcccaaggcatgggaggatgcttgcaagttttcacctgagaggttcttaaattcaagtattgatttcaaaggaaatgattttgagctgataccatttagtgctgggagaaggatatgcccagggatgcccatagcaattcagtttgtcaatttgtttgtagctacattggtacaaaattttgagtgggacttaccaaatggaatggatcctagagatttggtgatggatgacaaatttgggttgacactgcaaaaggaaccaccactctatattgttcctaaatcaagggtttga

SEQ ID NO: 104 - DNA, 1467 bp, Chelidonium majus
atggagattatcacagtagcactcatagcagtagtaatctcttcgatactatacctcatctttcgtgacacaagtcctaaaggtctaccaccaggcccaaaaccgtggccaattgtcggaaacctccttcaactcagtgacaaaccccatgcccaattcgccgagctcgctcaaacctatggagatctctttacactacgaatgggaactcaaaccgtggtcgttgcttcaaccccgacagcagctgccgaaatcctaaaaacccatgatagaattctctctggtcgttacgtttttcaaagtttcagagtaaaagagcatgttaaaaactccattgtttggtctgaatgtaatgatacttggaaaagtttaagaaaagtttgcagaacagagctttttacacagaaggtgattgagagtcaagctgaaattagagagagaaaggcttgggaaatggtggaatatttgaagaaaaaacaaggtgaagaagtgaagattgttgaggtgatttttggtacacttgtgaatatatttggaaatttgatattctcacagaatatttttgacttgggtgatccaagtagtggaagtgtggagttgaaggaacatctgtggaggatgttggagttggggaattcaacaaatccagctgattattttccaattatgggtaggtttgatttgtttggacagagaaaagaagttgaagattgtcttcaggggatttatgatgtgtggggtgctatgcttaagaaacgtaaagctgctaaggaggctggaaacagtgaaggaggaaatgattttgttgaaattttgcttgattctggtcttactgatcaacaaatcaacagcttgctcatggaattgtttggtgctggcacagaaacaaccgcatcaacactagaatgggccataactgaactcaccaagaacccaaacgtaacagctaagatgagatcagaattggaaactgttgttggccataacacagtaaaagaatctgatatacctaatcttccttatctccaagcttttgttaaagaaagcctacgactgcacccaccaacaccattgttactaccgcgacgagcacttgagacatgtcgagttctaaactacacgattccaaaggagtgtcagatcatggtgaatgcgtgggctatagggcgagaccctaaaatatggaccgacccgttaactttttccccggagaggttcttgaattcaagcattgactttaaagggaccgattttgagttgataccatttggtggagggaggagaatatgccccggtataccattggcaactcagtttattggccttattgccgctactttggtacagaattttgagtgggacttaccaaatgggatgagccctaaagagttgaacatggaagagaagtttggattgacattgcagaaggaaccacctctgtacattattcctaaatcaagggcttga

SEQ ID NO: 105 - DNA, 1488 bp, Cissampelos mucronata
atggaggtagtcgcagcaactattggtctcatcgcctttgccatcttcatctacattttcttcatcaaagatcaatccagcaaaaagggtctcccaccaggcccaaaaccattgcctatagtgggaaatctactccaactaggagaccaaccacacgcccagtttgctcaattggctcaaacctatggcgacctcttctcactcaaacttggatcacagacagtagttgtagcctcaacaccagctgcggccacccaagtcctcaaaacccacgaccggatcttctccggccgctacgtcttccaaagcttccgagtcgaaaaacatgtcaacaactccattgtctggtccgagtgcaatgagaattggaagatgttgaggaaggtgtgcaggacagaactgttctcagctaagatgatagagtcacaagctcacttgagggaggccaaggcaatggagttggttaagttcttgaagggtagggaaggccaagtggtgaagatcaccgaggttgtgtttggtgttttggttaacatatttgggaacttgatattctcacaggatgtgtttgatttgagtgatcccactggggggagtgccgagatgaaggaccatatttggcagatgttggagatggggaactctgctaatcccgctgactacttccctttcttggggaggttcgatttgttcgggcagcgccgcgccgtcgccaactgcctccagcagatctatgatgtttggggcgccatgttgagggagcgccgccgcgccgccaagaagggggatgggagtactccccctcaccatgattttgttagtatcttgcttgatgctggcttggatgaccaaaagatcaatgctttgctcatggaattattcggagcgggaacggagacaagttcatcgacaatagagtgggcgatagcggagctgactaaaaacccgtcgataaaggaaaaactactactagagttggataatgtagtaggcaaggaggaggtgaaagagtccgatatacctagactcccctacctccaagcctttgtgaaggagaccttaaggctacatccggcgacgccaatgctcctccctcgaagagccctcgaaacatgtcaagtcatggggtatacgataccgaaggactgccaaataatggtgaacgcatgggcaatcgctcgagacccgaaaatatggaaggaaccattgaggttcttgccagagaggttcttggattcaagtttggatttcaaggggaatgactttgagttcataccatttggtggtgggaggaggatttgcccaggcattccattagctacacagttcatagggatcattgtggcaacactggtgcagaatttggactggagtttgcctaatgggatggatcctagtgagttggtcatggaggagaagtttggtttgacactacaaaaggagccacctttgcttatagtgcctaaagcaaaagacttgtgtaagtga

SEQ ID NO: 106 - DNA, 1479 bp, Cissampelos mucronata
atggaagtagtaacgctgctactttctctactatcttccatccccttaatcctcctcgtctacctcctcctcctcctcaagcccaaacccaacctcccccccagccccccctcatggcctctcatcggcagcatccccgccatcctcggctccagcaagcccctccacctgaccctcaccgacctcgcggcggcccacggggccctcatgctcgtcaccctcggcaccgcccccaccgtggtcgcctccacccgcgccgccgccatggaggtcctcaagacccacgacaagtccctctccggccgccacatccgcatgagcttccgcatcaaagagatgaacaggcactccctcgtctggtctaactgcaccgacacgtggaagctcctcaggaggcttgcgcggaccgagatattctctcccaagatgctccaggcgcaggagcccgttagagagagaaaagttggcgagctcgtccacttcttgagagagagggaaggggccgttgtgaagatcagcgagttcgtgtttggcacgcttttgaatatcattgggaacgttgtgttctccaaggacgtgtttgggtacggcgacaaaaacgagattgggatgcagagcttgattaaggagctgttggtcatcggggcgagcccaaacgtggccgagttttatccgatccttgaagtgttggacttgcaagggttgaggcggaggtgcgcggaccgggtcgcccgagttaacatgctctgggaatcgacggtcaagaagaggaggattagtaggggcggtgatcccgaggacatgttggacgtgcttcttgataatgggttcaacgacgttcagatcaacgtcttgtttctggagatgtttgggccgggctcagagaccagtagtgcgaccatagagtgggccttagctgagctgataaaaaacccagacaagctagcgaaagtccgcgaagaattggaccgagtggtcggcccaacgtcacaagtgaatgaagcccacatccctcacctcccatacctccaggcctgcatcaaagaaaccatgaggctgcacccggccgcgccatttctacttccacaccgagccgtggagacttgccaagtcatgggctacaccatccctaaggactaccagctcctcgtcaacgcttacgccatcggaagagaccccgagtcctggaacgagccttcgaagtttatgccagagcggtttttggagtcggaggtggactacaatgggaaccatttcgagttcattccattcgggtcggggcgaagaatatgcattggcatgcctttggctactcgaaccgtgcctctcattgtctcgtctttgatgcataattttagttggagcttaccggacgggaggcgcaacgaagagttggagatgaatgagatgttgagcttgtctttggccattgatccaagtctcactataatccctaaagcgagaatcctacatgcataa

SEQ ID NO: 107 - DNA, 1494 bp, Cissampelos mucronata
atggatcaactcacgttactatcactaattctcttatccacacttctcatatgtctcttgttttctttcgagttcaaacgttacatatccaaaagactccccccaggtcccttcgtttggcctatgatcggaaccgtatttatgagcgtgagcgaggctcaggaccacattgtattggccgacctggcgagaaagtacggccccctcatgatggtcaagttcgggctggcaccgccgctgatggtggcctcgaaccatgcagcggcggcggagatactcaagacgcatgacgtcgcttgctgcggccgcgaccccccgcatagcgtgaagttgcccggttacatagagcactccatggtgtggggggactgcaccgagcactggaagatggtgaggaagatatggaggacggagctgttctctgccaagatggtggactcgcaggcggggataagggaggagaaggtgagggagttggtggggtttttgagggggagaggaggggaggtggtgcagctaactgaagccatatttgggtgcattatcaatgtattagggtctattatttttaacaaaaatgtgtatgactatgaggggagggttgataatgagaagggaatgaagggtatgatcagggagctcataatgttggcggcgacgcctaacttgccggatttttttccggtgtttggtctcttggacttgcaagggattgggaaaaggactggtgagtgtgtgaagaggatgaatgagtactggggagtaatagtgaaggagaggagggcaagcaaggatcattccaggaatgacttcttggatgtgttgatccaagctggcttcaccgatgctcaaattgatgccttgctcttggaaatatttggtcctggttcagactctacctcatgtaccatagagtgggcgatgtcggagctcattaagaaccctaacaagctattgaaactccaagaggagctcaacacagtgattgggcagaacagagaagtgaaggaatctgatctagaaaacctcccatatctccatgcatgcataaaagagaccttgagactgcatccaccggtgactttccttctccctcaccgcgcaaccaagacgtgcgaggtgatgagttacaccattcctaaggaatcaggaatcttcgttaacacttacgcgattcacagagatccaacggtgtgggaggactcgtcgatgttcaagccagagcgatttttgaattcgacggtggactaccagggcaatgactttcagtatataccatttggtgcgggtcggagaatgtgccctgcgcacaacatggcttcgaggacaaccaggattatgttagcttctttgattcacaatttcgagtggagcctgcctaatggaatggcaccgagcgagttggacatgcaagatacgttcgtgatggtgcttgccaaagcagttcctctcagtgtcatcgcgagagaaagatcagtatgtgtgagttcatag

SEQ ID NO: 108 - DNA, 1344 bp, Cocculus trilobus
tggtctctgcaactattggtttcatcttcttcatcatcttcattttcttcttcttgaagaaacaaaacacatcaacaaagggtctccctccaggccctaaaccatggcctatagtgggcaatctcctccaactaggagacaaaccacatgcccagtttgctcaactctcacaaacctatggagacctcttctccctcaaacttgggtctcaaacagtagtagtagcctcatcaccaactgcagccactcaagtcctcaagacccacgaccggatcctctccggccgctacgtcttccaaagcttccgcatcgaaaaacatgtcaacaactcaattgtttggtctgaatgcaatgacaattggaagatgttgaggaaagtttgtaggactgaagttttctcaacaaagatgattgagtcacaagcccacctaagagaggccaaagcaatagagatggttgagttcttaaaagggagagaagggcaagttgtgaagattgctgaagttgtgtttggaacactagtgaatatctttgggaacttaatattctcacaagatgtctttgatttggctgatcctactagtgggagtgctgatatgaaggaccatatatggaagatgttggagatggggaactctgctaatcctgctgattactttccattcatggggaagtttgatttgtttgggcagcggcgtgccgttgccgaatgccttcagcagatttacgacgtctggggcgctatgttgaaggagcgtcgcggagctgcgagagggggaactggagctaacaatgattttgtcagtgttttgcttgaagctgggctggatgatcagcggatcaatgccttgctcatggaattatttgcagcgggaacggagacgagttcatcgacgatcgagtgggctatagcagagctgacgaaaaacccaccaataagggagaaaatatatagagaattggagagtgtagtaggcaaagagagggtgaaagagtcagatatacctaggcttccatatctccaaggctttgtgaaggagacattgagactacacccagccacgccgatgcttctacctcgcagagcgcttgaaacatgtcaagtgatgggctacacaataccgcaagactgccaaataatggtgaacgcttgggcgattgcgcgagacccgaaagtgtggaaggatccattgaagttctcaccagagaggttcttgaattcaagtttggattacaagggaaatgactttgagttcataccatttgggggaggaaggaggatttgccctgggcttccattagctagtcaagttcataaggcctcattgtggcaactcttgtgca

SEQ ID NO: 109 - DNA, 1453 bp, Cocculus trilobus
actttctcttttatcgttcattccctttgttatcgttctctaccttctcttcaagcccaaacacaacctcccaccaagcccccgcccttcatggcctctaataggcaacataccagccatcctcggcagcaaaacacctcttcacgtcaccctcacggacctggctcaagtccacggccctctcatggtcgtcaccctcggcaccgctccgactgtcgtcgcatcgacccgcgaggcggccatggaggtcctcaagacccacgaccgagccctctccgggcggcacatacgcatgagcttccgcataaaagagatgaacaaacactctctcgtgtggtctaactgcacggacacatggaaactcttgagaaagctagcaaggacagagatcttctcgccaagaatgcttcagatacaagagcctgtgagggagaacaaagtgggtgagcttgtggagttcttgagagggagagaagggaaggttgtgaagataagtcagtttgtgtttggaacacttttgaatataattgggaacgttgtgttctcgaaagacgtgtttttgtttgatgatgataagattgggatgcagagtttgataaaggaattgttgatgattggtgcaagtccgaacttagccgagttttatcccattcttgaagtgctggacttacaagggttgaggcggaggtgtgcagaccgagttagcaaagttaataagctttgggaatcgacggtgaaggagaggagactcggtaggagtggtgatgccaaggacatgttggacgttcttcttgataatgggttcagtgatgttcagatcaacgtgttgtttttggagacgtttggtcccggttcagagacaagtagtgcaaccatagagtgggtgatggccgagctgatcaagaacccagacaaactagccaaactccgcctagaattagaccaagtagttggtccaacgtcacaagtgaaggaagctcacattcctctgctaccctacctccaagcctgcgtcaaagagaccatgaggttgcacccagccgcaccatttctgctcccacaccgagccgtggagacctgccaagtgatgggctacaccatccctcaagactaccaagtcctcgtcaatgcctacgccattggaagggaccctgaatcatggaaagacccttcagagtttaggcccgagcggttcttggagtccaatgtggactacaatggaaaccattttgagttcataccgtttggatctgggagaagaatatgcattggaatgcctttggcaactcgaactgtgcctctgattgtgtcgtctttggtgcacaacttttattggagcttaccagatgggaagagcccggaagagttggagatgaatgagattttgagcttgtcactggcaatagatccaagtctctctattaatcccaaagtgagagcactgaatacataa

SEQ ID NO: 110 - DNA, 1467 bp, Eschscholzia californica
atggaggttgtcacagtagcacttattgcagtaataatttcttcaatactatacctcctctttggtggtagtggtcacaaaaatctcccaccaggaccaaaaccatggccaatagtaggaaatctcctccaacttggtgagaaaccacacgctcaattcgccgaactagctcaaacctatggtgacattttcactcttaaaatgggtactgaaactgtagttgttgcatcaacatcttcggcagcttccgaaatactcaaaacccatgatcgaattctatccgctcgttacgtttttcaaagttttcgagtaaaagggcatgtagaaaattcaatagtttggtcagattgtactgaaacttggaagaatttaagaaaagtttgtaggacggaacttttcacacagaagatgatagaaagtcaagctcatgttagagagaaaaaatgtgaagaaatggttgaatacttgatgaaaaaacaaggggaagaagtgaaaattgtggaagtaatatttggaacattagtgaatatattcggaaatttgatattttcacagaatatatttgaattgggtgatccaaatagtggaagttcagagttcaaggaatatctatggaggatgttggaattggggaattcaacaaatccagctgattattttccaattttgggtaggtttgatttgtttggacagaggaaagaagttgcagagtgtttaaaagggatttatgctatttggggagctatgcttcaagaaaggaaattagctaaaaaagttgatggataccaaagcaagaatgattttgttgatgtttgtcttgattctggacttaatgattatcagatcaatgccttgcttatggaattatttggggcaggcacagaaacaagcgcatcgacaattgagtgggccatgactgaactaacaaagaatccaaagataacagctaagattagatcagaaattcaaacagtggtaggcgagagatcggtaaaagaatccgacttccccaatcttccataccttgaagctactgttaaagaaaccctaagacttcacccaccaactccattgctactcccacgccgagcacttgaaacctgtacaatcctcaactacaccatcccaaaagattgtcaaattatggtcaacgcttggggaatcggtcgtgatcccaagacttggaccgatccgttgactttctcaccagagagattcttgaattctagtgttgactttagggggaatgatttcagtttgataccatttggtgcaggaagaaggatatgccctggtctgccaatagcaaatcagtttattgcattgctagtggcaacatttgtgcaaaatttggattggtgtctaccaaatgggatgagtgttgaccatttgatagtggaggagaagtttgggttgactcttcaaaaagaaccacctctattcattgttcctaaatcaagggtttga

SEQ ID NO: 111 - DNA, 1467 bp, Glaucium flavum
atggagattgtaacaattgcagttatagcagtagtgatctcatccatattctacttcatcttccgtgacactagtcctaaaggtttaccaccaggtccaaaaccgtggccaattgtcggaaacctcctccaactcggcgaaaaaccccacgctcaattcgctgaacttgcccaaacctatggagatctctttacactacggatgggaactcaaactgttgtcgttgcctcaagtccttcggcagctgcagaaatcctgaaaacccatgatagaattctctcgggtcgttatgtttttcaaagttttagagtaaaagagcatgtagaaaactcaattgtttggtctgaatgtaatgatacttggaaaaacttaagaaaagtttgtcggacagagctttttactcagaaaatgattgagagtcaagctcatattagagagaggaaggcatgggaaatggtggaattcttgaagaaaaatgaaggtcaacaagtgaagattgtggaagtggtttttggaacacttgtgaatatatttgggaatctgatattttcacagaatatatttgaattgggtgacccaagtagtggaagtgtagagttgaaagaccatttatggaggatgttggagttggggaattcaacaaacccagctgattattttccaattatggggagatttgatttgtttggacagagaaaagaagttgcagattgccttcaggggatttatgatgtttggggagctatgcttaaagaacgtaaagctgctaggaaggctggtggtaatcaaggaaagaatgattttgttgaagttttgcttgattctggtcttaatgatcaacagatcaacgccttgctcatggaactgtttggcgcaggcacagaaacgtccgcatctacaatcgagtgggccataactgagctcacaaaaaacccaaaagtaacggccaaaatccaatcagaattgctcaccgtcgtgggcaggagctcaataaaagaatctgatatacctaaccttccttatctccaagcttttgttaaagaaacccttcgacttcatccaccaactccactgctactcccacgaagggcacttgacacatgtcgagttttgaattacacgatccctaaggagtgccagatcatggtgaatgcatgggccataggacgtgaccccaagacatggacggatccattatctttttcaccagaaaggtttttgaattcgagcattgatttcaaaggaaatgattttgagcttataccatttggtgccgggagaaggatatgcccaggggtaccattagcgacgcagtttattggtcttattgtggccactttggtgcagaattttgagtggggtttaccaaatgggatgaaacctggagatttgaacatggaggagaagtttggattgactttacagaaggaaccacctctatatatcataccacaatcaagggcttga

SEQ ID NO: 112 - DNA, 1467 bp, Hydrastis canadensis
atggagcttctttcaatagctattgctttcttgttcttcttcttccttcgaatcatcttccatgattcaaacagaaagaaccttcccccaggacctcgtccatggccaattatcggaaatcttctccaactcggcgagaaaccgcacgccgaatttgctaaactagctcaaacatatggtgatctttttactttaaaactaggctctcaaacagtaatagttgcttcatctccagcttcagcaactgaaatactcaaaacccatgatagaattctctctagtagatatatttttcaaagttttcgcgtaaaagatcacgtcgaaaactccattgtttggtctgaatgcaatgagaattggaagttattgagaaaagtttgtagaactgagttgttttctcctaagatgattgaatcacaagctcatgttagagaagctaaagcattagatatggtaaagtttttgaaaagaaaagaaggggaagtagtgaagatggttgaaatagtgtttggaacacttgttaatatctttggaaatttgattttttctaaagatgtatttgatttagaagacccaacaggtggaagtgcagagatgaaagaacatttatggaaattattagatatgggaaattctactaatccagctgattattttccaataatgggaaaatttgatttgtttggacagagaaaagcagtagcacaggtacttcaacagatttatgatgtttggggtgttatgttaaaggaaagaagaaatagaaaaggaagtgaaaataatcatgattttgttaatgttttgcttgatgctggacttgatgatcagaagatcaatgccttgcttatggaaatattcggtgctggtacagagacgagcgcatcaacaatcgagtgggcgatagctgagctcacaaaaaatccacgtgtattgtcaaaaatagcatcggagttagttaatgtggtgggtgaagaaacagtaaaagaatcacatttacctaatttaccatatctccaagcttttgtcaaggaaacactacgattacacccaccaacaccattgctactcccacgtcgtgcttctgacacgtgtcaagtcatgaattacactatccctaaagattgtcaaatcatggtcaacgcttggggtattggaagagatccaaagacttggaatgatccattgactttcaaacctgagagatttttgaattcaaatgtggattataaagggaatgattttgaattgataccctttggtgcagggagaagaatttgccctggacttcctttggctagtcagtttattaacctaatcgtggctactttggttcaaaattttgaatggagtttacctcaaggaatgagtccaagtgaactgaccatggaggagaaatttggattgacactccaaaaagaaccacctattctccttgttcttaaagctagggtttcgattaaatcgtaa

SEQ ID NO: 113 - DNA, 1461 bp, Hydrastis canadensis
atggatctcacaattgcactattttcattcattccaatcatccttgtttttgtacttcttttaaaacccaaaaccaaaaaccttccaccaggtccttctgcatggccattaattggcaatttaccaactctttttagtaaccctaatgtaccacttcatgtcactttaaccaacttggctaaaacccatggtccagtaatgcttttatggcttggtactcaacctacagtcatagcttcaactgatgaagctgctatggaaattcttaaaactcatgatcgagttttctccggtcgtcatgttcgtatgagttttcgcttaaaacaccatatcaagtactctcttgtttggtctgattgcacagattactggaaacttcttcgtaaaattgctagaactgagatcttttcagttaagatgttacaagttcagtctcatgttagagagcagaaggtagctgagttggtggagttcttgagaagtaaacaaggacaagcagtgaaaatcagtcaatttgtgttcggaactttgttaaatatattagggaacgttgtgttctctaaggatgtttttatttatagtgatgaagaagataaagagggcattcaacctttgataagagaaatgcttatgataggagcagctcctaatgttgctgagttttatccgattctcgaagaactcgatttacaagggttgaaacggaggtgtgcagaccgattcatccaagtcatgaaattgtgggaaggaactgttaaagaaaggaaacagaataggaatgaagagtcaaaggacatgttggatgttctacttgctaatgacttcaatgatgctcagatcaatgctcttttcttggaaacattcggtcctggctctgaaactagcagtgcaacaatcgagtgggtgatggctgagctcattaaaaatccaaacgaaatggcaaaagtacgtaaagaattggacgaaatcgtgggtgcatccaacgtgaaagagtcacacctcccccaccttccataccttcaagcatgtattaaagaggcaatgcgattacaccctgctgcacccttcctactccctcgtcgagctgttgagaaatgtgaagtcatggggtacaccattccaaaggactgccaagtcctagtgaatgcttatgcaattggaagagatcctaaaacatggaagggcccatcaacgttccgaccagagcgcttcctggaatcggatattgattaccatggtggtcattatcagttcattccatttggttcaggaaggaggacttgtattggaatgcctttagctactcgaaccattccattgattgttggttctttggtgcaaacatatgattggagtcttcctggtggaaagcgccctgaggaattggaaatgaaggaaatgttgagtttgtcgctggctatagatccaagtctatgtgttgtaccaaaactgagggcctaa

SEQ ID NO: 114 - DNA, 1494 bp, Hydrastis canadensis
atggaagaaacatttgtagtgataagaaaagcaaatctattctactatcttctccttcttgttctatctcttctttttcttatccttaagcatataaggtctccaaataatcttccaccagggccatttccatggcctattgtaggcaatattctcaatatgggaaacagaccacatatctcagtagcccaattagcaaaagtccatgggccacttatgtcactacgccttggtactcaactcgtcgtggttggatcatctccggcggcagccacagagatactaaaaacccatgatcgaatattatctggtcgatgtgtaccacatgcaacaccggctagtccaaatgatgtccatttatcgatgtcatggtcggattgcaccgatcaatggaggcttttacgtaccctttgccggacagagttgttttcagccaaagtgattgaatcacaagccaatgttagagacaaaaaggttgttgaattggtggagtttttggctacaaaggaaggtaaaatggtgcaaattgtagaagttgtttttgctactatttttaatatgttgagcaatctatttgtatcaagagattttattaagttggatgaaaagagagaagatgggggtgtgaagggacttataaagggtttggtggaattgggttttactccaaatttagcagacttatatgacatatttagtggatttgatcttcaaggtctaaacaagaagtccaaggaaatgtttctgaagatatgtggtgtatgggaggtaattgtcaaagaaagaagagaaggtaaaagtaatgatacttcaaggcaaagagattacttggatgctttgcttgacagtggacttaccaatggtcatatcaactacatgtttctggaacttttccttgctggtacagatactagtacctcaacaattgagtgggcaatggcagagcttataaaaaatccagaggccatgaaaaaagttaaaattgaacttgagagagagatcaatggcaatgttgttacagaatctgatcttccacagttaccttatctacattccgtcgtaaaggagacactaagattacaccctcctgcaccatttcttgttcctcattgtgcactcgagacatgcaaagttatgaattacacaattcctaaagacactcaaatattcgtgaacgtatgggcgattggaagagatcccaatatttgggatgaccctttaacttttaagcctgaacgatttgtcgaatcaagtatggacttaaattccaacaatttcagattcataccctttggttctggaagaaaaatctgtcctggattaccaatggctgctaagcaagttcccttagttcttgcttgtttgatcaaatgttttgattggtctcttccacatgacataactccctccaagctaaatatggatgaaaaatttggtattacagtgcagaaggaaaaacctctagtcctcattcctaaagtgaagaaatcataa

SEQ ID NO: 115 - DNA, 1458 bp, Jeffersonia diphylla
atggagctgatcactggtgtagtaatagcaatctctttcttcctcgtctacctccttataagcaatcgtctaagtcgaaagggtcttcccccaggccccagaccatggccgataatcggaaatcttctccaactaggcgagaaaccgcatgcagaatttgctaaactagctcagaaatatggagacctctttactttaagactaggcactgaaacagttgtagtggcttcatctccggcagcagcagctgagatactgaagacgcatgaccgaattctctcggggcgatatgtttttcaaagctttcgtgtaaaagagcacgtcgaaaactccattgtttggtgccaatgtaatgacaactggaagatgctgagaaaagtgtgtaggacagagttgtttacgcctaagatgattgagtctcaagcacatgtaagggaggctaaggcattggagatggtgagttttctgagaggtaaacaaggggaggtggtgaagatatctgaggtggtgtttggaaccttggttaatatatttgggaacttgttgttctctcaggatatttttgatttagctgatcctactagtgggagtgtggaaatgaaggatcacttgtggaaaatgcttcagttggggaacagtactaacccggccgattactttcctttcctcggtaggttcgatttgtttggacagaggcgcgctgtggctgactgtctgcaacgcatttacgacatttggggggctttgctcaaggaacgccgtggtagcaatgccagtaaagatcaccatgattttgtgaatgttttgattaatgctgggattgatgaccagaagatcaatgccttgctcatggaactatttggcgccggtacagaaactaccgcatctaccattgaatgggctgtagctgagttaacaaaaaacccacatatagcagccaaagttcgacaagagttgctgaatgtcttaggcaaagatccgataaaagaatccgacataccacgtcttccctacctacaagcttttgtaaaggaaacactgcggttacaccctgccacaccattgctcctaccacgacgcgctcttgagacatgtcaagtgatgaattacaccattcctaaagactgtcaaatcatggtgaatgcttggggaattgcaagggatcctaaaatatggaatgatgctatgacattttcgccagagagatttttgaactcaagcgtggattacaaaggaaacgattttgagctgattccctttggaggagggaggagaatttgtcctggaattcccctggcaactcagttcattcatctcattgtggcaactttagtccagaattttgagtggaagctacctaaagaaatggatcccagtgacttgaccatggaagagaagtttggtttgacactacagaaagatcctcccctttacatagttcccaaaagtactctgtaa

SEQ ID NO: 116 - DNA, 1452 bp, Jeffersonia diphylla
atggagctaacaactgcactgctttacttgatcccaactatctttctcatcatattcttgaaacccagaaacaagaactatccaccaggcccaaatccatggcctataataggcagcataccagctctcttcggcagtgggacgccaatgcacgttaccctagccgacatggctcacacgcatggtccactaatgatggtctggctcggaacccagccaacggcagtagcatcaacagcagagtcagctatggagattctaaagacgcacgaccggctctttgccggccgggctatccgtatgagctttcggttaaaacaccacattaagtactcccttgtttgggctgacaccagtgaatactggaagctcctgaggaaaatagtccgaaccgagatcttttcacctaagatgctccaggttcaggaacatgttagggaggagaaggtggcggagttggttgagtttttgaaggggaaggaaggacaagtggtgggagtaagtcagttggtatttggtacattgttgaatattctgggaaatgtggtgttctctaaggatgtgtttgcttatgttggcgccgagggtgataagatgcagactttgattaaagagatgcttatgattggagctgctcctaacatagctgagttttggccaatttttgaggagtttgatttccaagggttgaagaagaagtgtgatcaaagattcaaggtagtgatgcagatgtgggaaggaacagtggaggaaaggaaagtgaaaaggaatgaggagcctaaggatatgctggatgtactacttgtcaatgacttcaatgatgctcaaatcaatgctctgttcttggaaacatttggtcctggttctgagaccagcagtgcaacaattgagtgggcaatggcggagctcataaaaaacccaaatataatggccaaagtccgtgctgaactggaccaggtcgtcgggaaatctactgtgaaggagtcggacctccctcaccttccctacctccaagcatgtataaaggagacaatgcggttgcacccagctgcaccttttcttctccctcacaaatcaatggagacctgcaaagtaatgggctacaccattccaaaaggcatccaggtcctagtaaacgcttatgcaataggaagagatcctaaaacatggaaggacccaacgactttcaaaccagaacgtttcctggagtctgacattgattactatggtaaacacttccagtttataccatttggttctggaaggagacagtgcgttggaatgccattggctactcgaaccataccgttaattgtgtctaatctagtgcacaaaattgactggagccttcctgacggcaagcgtccggaagagttagtaatgaatgaaactttaagcttgtctttggccttagacccaactctgagcgtcatcccaaaactgagggtgtaa

SEQ ID NO: 117 - DNA, 1455 bp, Mahonia aquifolium
atggatctcattacatgtctagcaatactaactttgttcttcttcctctacttcttcataactgaccatttaagtagaaagggtcttcccccagggcctagaccatggccaataatcggaaaccttctccaactaggcgaaaaaccccattccgaattcgccaaactagcccaaacatatggtgaacttttcactttaaagctaggaacacaaacagtggttgtagcttcatctccagcagcagctgctgaggtcctaaagacccatgatcgtattctatccggtcgttatgtgttccagagctttcgggtgatggaacatgtcgagaactccatagtttggtgccaatgcaatgataattggaagatgttgaggaaagtttgtaggactgagttgttcacacctaagatgattgagtctcaagctcatgtaagagaaggtaaggcattggagatggtgagattcttgagaagtaaacaaggacaagtagtgaagatgactgaagtggtgtttggaacactagtgaatatatttggaaacttgatattctcacaagatgtgtttgagttgggtgatccaactagtgggagtgtggagatgaaagagcacttgtggagaatgcttgagttggggaactctactaaccctgctgattacttccccttcatgggcaggtttgatttgtttggacaaagacgcgatgtggctgagtgtctcagacaaatctataagatttggggtgttatactcgaagaacgtcgcaggagtggctcaaaacagaacaatgattttgtcgatgttttacttaatgctggaattgatgacaagaagatcaatgccttgctcatggaactgtttggagctggtacagaaactagtgcgtcaacaattgaatgggcaatagcagagttaaccaaaaatccacatgtaacaaaaaaactccggaatgaattactgaatgttgtgggcaaggcaacagtgaaagaatctgatataccccgacttccttacctacaagcttttgtgaaggaggtattgagattacaccctccaacaccattgcttctaccccgtcgtgcccttgaaacttgccaagtgatgaactacactattccgaaagaatgtcaaatcatggtgaatgcttgggccattggaagagaccccaagacatggactgatccactgacattttcgccagagcggtttttgaactcaagtgtggattacaaagggaatgattttgagttgattccatttggtggagggaggagaatctgcccaggagtccctttggcaactcagttcattcacctcattgtggctactttggttcagaactttgagtggactctgcctaaagaaatggatgccaaggacttgaccatggaagagaagtttggcttgactctgcagaaggatccacctcttttaattgtacccacagctaggatttga

SEQ ID NO: 118 - DNA, 1455 bp, Mahonia aquifolium
atggatctaaaaactgcattcctttacttgatcccaattgttcttgtatattatattctcttcaagcctaaacacaagaacctcccacctggtccaaaaccatggcctttgataggtaacataccagtattatttggcagcgggaagccactccatgtcaccctaactgacatggcgcgtacccacggaccaattataaccctgtggatgggaacccagccaacagccatagcttcgactgcagagtcggccatggagattctcaaaacccatgaccgtctcttctctggcagggctgtccgtatgagctttcgcttgaaacaccatatcaaatattcccttgtttgggctgactgttcggaatactggaaactcctgcgtaaaatagtcaggacagagatattttcacctaaaatgctccaggttcaggagcatgttagagaaaagaagatggaggagatggtggagtttctgaaaggcaaagagggggaggtgctgaaactcagtccattggtgtttgggacattgctgaatgtgttgggaaatgttgtgtactcgaaggatgtgtttggatactttggtgatgatggagatcaaatgcagactttgatgaaagagatgctcatgattggagctgctccaaacgtggcggagttttggccaattcttgaggggttggatttacaaggcctgaaaaagaagtgtcacgaacgattcacggaagtcatgaaaatgtggaaggggactgtggaggagagaaaagtcaacagaaatgaagagcctaaggacatgttggatgttcttcttgccaacgacttcaatgatgatcagatcaatgctctattcttggaaacatttggtccaggttcagagaccagcagtgcgacaattgagtgggcgatggctgagctcattaaaaatccaaaaataattgccaaagttcgtgaagaattggaccaggttgtagggaaatccttagtaaaagaatcacacctgcccaaccttccctacctccaagcatgcatcaaagaaacaatgcgactgcacccagcagcacccttcctgctaccccacagatctgttgaggcatgcacagtgatgggctacactattccaaaagacatacaagttctggtaaatgcttatgcaataggaagagatcctaaaacatgggaagacccaacaactttcaaaccagaacgattcatggagtctgacatagattactatggtaagcacttcgagttcataccatttggaacaggaaggagacagtgtgtcggaatgcccttagcgactcgaaccattccattgattgtgtctaatctagtgcacgcaattgattggagccttcctgatggcaaaaatccagaggagttggtcatgaatgaaactttaagcttgtcactggctttagatccaactctaactgtcattccaaaagcaagggtgtag

SEQ ID NO: 119 - DNA, 1455 bp, Menispermum canadense
atggctctactagctctgttccttatctttgctcttcccattctcttgctttacttcctcaaaccctcttctcccaaaaaccttcctccaggcccattttcatggcctttgcttggaaccttggggctgaaatcaaacgaaaaacaagcccacgtcgtgctaaccaatttggctcaaacctatggcccgctcatgctgctaaagctcggagttaagcctgtgatagtggcatcaacccacgttgcagccatggagatcctcaagacacaagaccacgttctgtccggtcgttgccccccacatagcgtgcaagtcgaggactacatcgaggcctcagtagtttgggctgaccgtaatgaacactggaagatggtgaggaagatatgcaggacagaactgttctctactaagatgttggaatcgcaggcaagtattagagaggaaagggtgagtgagttaattgcgtttcttaggaggagagaaggagaagttgttaagatttcagatrtgatcttcggytgcatgatcaacgtattgggctcggttattttcaaccaaagcgtgtatgatttcgaaggcaaaaaggatacgggcatgaagggtatgattcgggagcttatgatattggcagcaaccccgaatctgccagatttttacccaatttttgatcggtttgacattcaaggcctgagaagcactacttcggcgtgttggaagaggatgagtgagtcatgggctggtatagttaaagaaagaagggccagcagagatcattcaagaaatgatttcctggacgtgttgatccaagctaacttcaccgacccacaaatcgacgccttattcttggaaatatttgcgcctggttcagatagtactacgaccgcaatggagtgggcaatgacggagcttatgaggaatcccgagaagcgcttaaatgtccaaaacgaactcaaaacggtgatcggaaacaggcaagtagtgaaggaatcagatctgccaaacctcccatacctccatgcctgcgtgaaggagagcttgagactgcacccaccagtgacgttcctgctgcctcataaagcaaccgagacgtgccaagtgatgaactacacgattcccaagggaacccagttgatggtcaacgcttacgccattggtagagacccaaagacatgggacgatccgctgtgtttcaagccagaacggtttttgaactcagaagtggattatcaagggaatgattttagtttaataccgtttggatctggtaggagaatgtgcataggaatgcctctggcttcgagggtcgtgagattgataatagcgtctctgattcacaactttgattggagcctacctggtgggataaaaccgagcgagttggacatgcaggagatgttcgaattggtgcttcagaaacacgttcctctctctatcatacccaatgccagagcataa

SEQ ID NO: 120 - DNA, 1485 bp, Menispermum canadense
atggagatagtctccactgtagctattggtttcatcttcttcatcatcttcatcatcttcttcttcagcaaccaaagatcaacaaagggtctccctccaggtcctaaaccatggccaattgtgggcaatctcctccaactaggagaccaaccacatgctcaattcgcccaactctcccaaacatatggccctctcttctccctcaaacttgggtctcaaacagtagttgtggcctcctcgccatctgcagccactcaagtcctcaagacccacgaccgtgtgctctccggtcgctacgtcttccagagctttcgcatcgacaggcatgtcaacaactccattgtctggtctgagtgcaatgacaattggaagctgttgagaaaagtttgtagaactgaagtgttctcaccaaagatgatagagtcccaagctcacttaagagaggctaaggcaattgagatggtggagtttttgagagggagagaagggcaggttctgaagattgctgaagtggtgtttggaacacttgtgaacatctttggcaacttgatattctctcaagatgtttttgacttggctgatcctactagtgggagtgctgagatgaaggagcatatatggaggatgttggagcttgggaactctactaaccctgctgattacttcccaattatgggcaagcttgatttgttcggacagcggcgagccgtcgccgagtgtcttcaacagatttacgatgtttggggggctatgttgaaggagcggcgcgctacgaaaggaactgagactaataacgacttcgttaatgtgttgctcgaagccggtctcgacgatcaaaggatcaattccttgctcatggaattatttgcagctggaacagagacaagtgcatcgacaatcgagtgggcgatagcggagctaacgaaaaatccacaaataatggccaaaatacacagtgaattggagagtgtagtaggcaaagagagggtgaaagagtcacacattcctcacctcccttacctccaagcctttgtcaaggagacactgagactacacccagccacacctatgcttcttcctcgccgagctcttgaaacatgtaatgtgatgggctacaccatcccgaaagactgccaaataatggtgaatgcctgggcgatcgcgcgagacccaaaagtgtggaaggatccactgaagttctcaccggagaggttcttgaattcaagcttggattacaaaggcaatgactttgagttcataccatttggtggaggaaggaggatttgccctggccttccattagctactcagttcataagcctcattgtgggtactcttgtgcagaatatggactggagtttgcctaatggaatggatcctactgagttggggatggaggagaagtttgggctgacactgcagaaggagccacctctgcttatagtgcctaaatcaagagattttttgaatgaaacaagaggctga

SEQ ID NO: 121 - DNA, 1464 bp, Menispermum canadense
atggatcttgcagtactattatccctcttcgttcccgctatcctcatctaccttctcttgaaacccaaaaacgtcccaccaggcccacgctcatggcctcttctaggcaacttgctaaccgtcctacgcagccacgtaccccttcacatcaccctcacagacctggctcgaacccacggcccgctcatgctcgtcacgctcgggacccagcccaccgtcctggcctcaaccagcgaggccgccatggagatcctcaagacccacgaccgagccctctcgggccgccacatacgcatgagcttccgcttaaaagagatgaacaagcactcgctcgtctggtccaactgcacagacacctggaagctcttgagaaaaattgctagaaccgagatcttctcgcccaagatgctgcagattcaggagcacgtgagggagcagaaggtgttggagcttgtggagttcttgagagggagagagtacttagggaaggcggtgaagatcagccagttcgtgtttgggacgctgttgaatataattgggaacgtcgtgttctcgaaagacgtttttgggtttagttgtgatgagggaggggatgagattgggatgcagagtttgatacgggagctgctgatgattggggcgagccctaacattgctgagttctatccgattctggaggggttggatttgcaagggttgaagcggcggtgcaaggaccgagttgaccgagttaacaagctgtgggaagggacggtcaaagagaggagactgaaaaggagtggtgagtcaaaagatatgttggacgttcttcttgataatgggtttgatgacgttcagatcaacgtcttgttcttggaaacatttggccctggttcagagacaagcagtgcaaccatagagtgggtgatggcagagctgatcaagaacccagacaaactagccaaggtccgaacagaactagaacaagtagttgggctgcactcacaagtgaaagaaagtcacctccctcatctccactacctccaagcctgtgttaaagagacaatgaggctgcacccagccgcaccgttccttctcccacaccgagctgtcgagacgtgccgagtcatgggctacaccatccctaaagactgccaagtcctggtgaacgcttacgccattggaagggacccaaacatatggaaagacccatctaggttcaaacctgagcgcttcttggagtccagtgtggactacaatgggaaccatttcgagttcataccatttgggtctgggaggagaatttgcattggaatgcctctagcgactcggactgtccctttgatcgtgtcctctttggtgcacaactttgattggagtttaccagatggaaaacgccctgaagagttggtgatgaatgagatgctaagcttgtcactagctattgatccaagtctgtctattatccctaaagtgagaggatag

SEQ ID NO: 122 - DNA, 1470 bp, Menispermum canadense
atggctctactagctctgttccttctctttgctctccccattctcttgctttacttcctcaaaacctcttctaatcccaaaaaccttccaccaggtcccttttcatggcctcttattggaaccttagtaatgaaattaaacgagaagcgacctcacgtcgtgctaaccaatttggctcgaacctatggcccgctcatgctgctcacgtttggaattgaacctattgcagtctgttccacccccgaagcggcaatggagatgttcaagacacaagaccgcgttatgtccggtcgttatgtgcctcatagcgtgcaagttaagggctatattgagcactccatggtgtgggccgattgcaacgagtactggaagatggtgaggaagatatacaggacagagttgttctctactaagatgttggaagcgcaagtgagtgttagagaggagaaggtgaaggagttaatggcgtttattaaaaggaaggaaggagaagttgtgaagattacagatgtggtctatggctgcattctcaacatattgggctcagttattttcaaccaaaatgtgtatgatttcgacggcaaaacagataatgatgcgggcatgaagggtatggttcgacagttgatgacattggcaggaatcccaaattttcctgatttttatccaattttcggtcgattcgacccccaaggcctgaaaaaaaaaactacagaatgtgtgaagaggatgaatgagtcatgggcaggtatagttaaagaaagaagggccagcaaagatcactccggaaatgatttcttggatgtgttgatccaagctaacttcaccgacccacaaattgactccttgctcttggaaatatttggacctggttccgattccagcacaagtacaattgaatgggcaatggcggaccttatgcggaatcctgagaagctcttgaaagtccaagatgaactagaaactgttattgggaggaacagagaagtgaaggaatcagatctacccaatctcccatacctccatgcctgcgtgaaggagaccttaaggctgcacccaccagtgacgtttcttctgcctcatcgagcaaccgagacgtgccaaatgatgaactacacggttccgaagggaacccagacgacggtcaacacttacgccattggtagagacccaaaggcatgggaggacccactgtgtttcaagccagaacggtttttgaactccgaagtggactatcaagggaatgatttccattacataccgtttggagcagggaggagaatttgcccggcagtgtctctggcttcaagagtgagtcgattgataatcgcgtctttcattcacgacttcgattggagtttgcccaatgggatgcaaccgagtgagctggacatggaggccaagtttggattggtgctatggaaagatgatcctctctgcatcataccccaaaaccagagccctatatag

SEQ ID NO: 123 - DNA, 1488 bp, Menispermum canadense
atggactcggtgcttgcaatcctctacctctccatcttcttcctcaccatcctcctcgttaagcttttccaacacaaatcacacaagtcgaaccaactcccaccagggcctcgtccatggcctatcttaggcaacttggtgagcatcttggggagcaagaccccaccccacatcaccttcgcgaacctcgctcgagcccacggcggcctcatgcttctctggctcggccagaaacccttggtggtggtctcagacaaggaagccgccgtggaagtcctcaagacccacgaccgagtcctatccggccgttccatcaccgtgagcttccgcttccgtgagaaaaccgagtactctctcgtttgggccgactgcaacgattactggaagctccttcgcaggattctccgaaccgagatcttttcgcccaagatgttgaagattcaggagcgagtgagagagcagaaggtaacggagctgatggagttgatgaggagtagcgaagggaaagaggtgacgatcaggccgttggtgtttgggactatattgaatatattagggaacgcggtgttctcaaaggacatgtttgagcttggtgggagaggagacaaagttgggttggagcagctgattcgcgagctgctcaccatcggttcgacccctaatatagccgctttctttcccattttcgagaagctcgacccacaaaggcttaaaaagcgaacttgggagcgacttgttaaaatagacaaactttgggagtccatagtgaaggaacggagacagcaggagaggagcgaagaatgcaaggacatgttggacgtccttctcgccaatgacttcactgacccacagatcgacaatatattcttggaaacttttggtcccggctctgagagcagcagcgcaacagtggagtgggtgatgtcggagctcataaaaaacccacaaacatttgcgaaactccgccaagaactggacaacgagttcggccaatccaaagtgattactggatctcgcctcacaaacctcccattcctgagcgcagtgatcaaggagaccatgcgattgcacccagcaattcctttcatgctccctcacagagcagtagagacatgcgaggtgatgggctacacaatccccaaggacatggagatccagttgaacgcttatgcgatcgggagagacccaaaagcctggaaagacccaaatacgtttcgaccagagcggttcttggagtccgatatcgattaccaggggaaccactttgagcttataccgttcggtgctggaagaagggtttgtcctgggctgcctctggccgtgaagaacacaccgttgattgtgtcctctctggttcatgggtttgattggagcctccctgatgggcttacgcacgaccagcttcagatgaacgaggtactctctgttgcgctgactaaggaccccagtctctgtctcatccccaaagtcaggatctgggcatcctaa

SEQ ID NO: 124 - DNA, 1509 bp, Menispermum canadense
tcgcacgctcttcgtctccttcttcttctcctcctcctctttctcttcttcttcagagactcatcatccaagaacctcccaccaggtccacctcccttccccatcataggcaaccttcatcaattaggctccaaaccccactccactcttgcacaattggctcaaacctatggtcctctcttgtctctaaggtttggctcccaattggtagtcatcgcgtcgtccccggcggcggcatcggaggtcctcaaggcccacgacaatgtcctctcgggccggcacataatatacaacgcccgctctaagaattatgtcgagcactcgatggtttgggctccagagtgcaacgaggcgtggaagaatcttcggcggatctgccggcttgagctgttttcgccgaaggcgatggaggctcgcgcgggtgtgagggagctcaaggtggaggagatggtgggtgttctaagagggaaggtaggggaggtggtgaaggtgagtgagttggtgtttgggaccattttcaatgtgcttgggggcttgatattctctaaggatgtgtttgacatgagaagggaagatggtgtggttgttggggacttgaagggtcatctgtgtaagatgttggagttggggagtgcagttagtttggcagattgttttcctaaactagggtggatgactggggggagaaaggtatctgaagagtgtaggagaaatgtgtttgggagttgggaggagataataagggagagaagagaattaagttctaattatggtgtaggacttggtgatggatgtgatgatgatgatgatgatggggctaagaaagattttctcagttctttgatcaaagcaggattcagcaatgatcagatcaataccttgcttctggacatttttggagctgctgcagatacaactacttcaacaatcgagtgggctatggtggaaataatgaagaacccacatgtactacacaagcttcaatctgaactacaattaatattaatggagacatcatcaaagaagaacaatattataactgaggccgacctctcgcatctcccatatcttcaagcaactgtgaaggagacactgagactgcaccctccaacacctcttctgctgcctcgacgtgcattacagacatgtaaggtcatgaactacactgtcccaaaaaactcccaaatattagtgaatgcatgggctattgggagagacacaaatgtgtgggaaaatgcactcaaattctggcctgaaaggtttttggaggattataagttggggaataatagttttaattttgtgccatttggtggtggaaggagaatttgtcctgggatgcccttagctgctgaacttactcccctgattttgggttctctgtttcataactttgattggtctctcccaatgggcatgactccttatgacttgaccacagaagaaaaatttgggttgactctccaaaaggaccctcctctcctccttgttcctaaggagaggcactga

SEQ ID NO: 125 - DNA, 1467 bp, Nandina domestica
atggatctagctatactcatattctccttcatcctgctactgttcgtgttccttgtattgaatgaccatctgggtcgaaagggtcttcctccaggacctcgtccatggccaataattgggaatcttctccaactaggagaaaagccacacgctgaatttgcaaaactagctcagaaatatggagacttattcaccttaagactaggctctcaaactgttgtagtagcctcttctccagcagctgcagccgaaattctcaagacccatgatcgtatcctctcaggtcgttacgtgttccaaagctttcgagtaaaagaacatgttgaaaactctattgtttggtgtcaatgcaatgataattggaagatgttgaggaaagtttgtaggactgaattgtttactcctaagatgatcgagtcacaagcacatgtaagagaagtgaaggcactcgaaatggttaaattcttgaaaaccaaacaaggggaggtggtcaaggtagctgaggtcgtatttgggacattggttaatatatttggcaatttgatattttcacaagatgtcttcgatttagctgatcccaccagtgggagtgtggaaatgaaggaacagttatggagaatgcttgagttgggtaatactactaatccagctgattactttcctttcatgggtaggtttgatttgtttggacagagacgggctgttgctgaatgtttacaacagatttacgacatttggggggttatgcttaaggaacgtcgtgctaattctactagaaatgtcaataatgatttcgtcaatgttttgcttagtgcgggacttgatgatcagaagatcaacgccttactcatggaactctttggcgctggtacagaaactacttcgtccacaattgaatgggctatagctgagttaacaaaaaacccacgtatagtgagaaaaattcaacaggaattgctgaatgttgttggcgaagcagcgacagctacagtgaaagaatcccacatacctcatctcccttatctacaagctttcgtgaaagagacactgcgattacaccctcccacaccgttactccttccccgtcgtgctcttgagacatgtcaagtgatgaactataccatccctaaagaatgtcaaatcatggtaaatgcctgggcaataggacgagatcctagaacatggaacgatgcactcgtgtttactcccgagagatttttgaactccaatgttgattataaagggaatgattttgagctgattccatttgggggagggagaagaatctgcccaggaattcctttggcaactcaattcattcacctcattgtggctaatatagtccacaattttgagtggagtctgcccaatgggatggatgttgggaaactgacgatggaagataaattcggtttgaccctacaaaaggacccacccctttacattgttcccaaagccaggacttaa

SEQ ID NO: 126 - DNA, 1467 bp, Nandina domestica
atggtggttcctttcgttttagctttctttgttctcttcatagcaccttttctcctacttttccttctcaaaccatccccaaaaaaccttcccccaggaccctttgcatggcccttaataggcaccatactccccaacgagaaacaaccccatgtagaactaaccaatttggctcaaacctatggtccaatcatgttgctcaaattcggggtcgaacatgttgtcgttgtgtcaaccaatgaagctgccatgcaagtcctcaagacccatgacctggtcttatccggtcggtatgccccgaatagtgtaaaaataaagggttatattgaatactccatggtgtggaatgattgcaatgagtattggaaaatggtaaggaaaatatggaaaacagaattgctttccacaaaaatgttggatgcacaagcttgtgttagagaggaaaaagtgatggaattggttgacttccttagaggaaaacgaggacatgtagtgaagtttgctgatttgatatatgggtgccttctgaacatattgggtgctatcgttttctctcaaaatgtttatgacttcgatgatacgagcaataatgagttgggtatgaaagcaatgattcgagagttgatggtgttggctgcaaatccaaataatttagccgatctttatcctatgctcggtggttcggattttcaagggttgaggaaggccacagctgcatgtgttaagaggatgaatgagttatggggttcaatagttagagaaagaaggaagacgaatgctcactttaagaatgatttcttggatgtgttaatcaaagctgacttcagtgatcctcaaattgatgccatgttcttggaaatatttggacctggttcggatactagtacctcaacaattgagtgggcgatggcagagttattacgaagtcctgagaagctaaaaaatgttcgaaaggaactcaacaatgttgttcttggaactaaacaagtgaaagaatcagacctacccaaccttccttacctaaatgccgtcgtcaaagagactctcagattgcaccctccagccacattcctactccctcatcgggcaatagaagaatgtcaagtgatgggctacaccataccgaagggatgtcaattgatggtgaacactcatgccattggacgggactccaaaacatggaacgatcctttgtcattcaaccctgagcgatttttattggacacggagattgattatcaaagtagtactgactttaagtacataccatttggggcggggaggagaatatgtcctgggttgtcgttggcagctcgagttgtgccattggtacttgcttcgcttattaacacgttcgactggagtttacctaatggaatggatccaagtgagctggacatggaggagaagtttggggctgcactctggaaggaggttccgcttttgatcatccctaaggttcaatga

SEQ ID NO: 127 - DNA, 1452 bp, Nandina domestica
atggaactgacaacttcacttctttgcttcattccgatcatccttctctacatactcttcaaaccatcaaacaagaatcttcccccagggccaaaaccttggcccttaataggcagcataccggccttgttcggcagtggttcacccctccatgtcaccctcgcagacatggctcgcacccacggtcctattatgaccttgtggcttggtaccaccccaactgttgtcgcctcaactcctgaatcagctcaggaaatcttaaaaactcacgacaaacatttctccggtcgggctattaggatgagttttcgcttaaaacatcatattaagtactcccttgtctgggccgactgcagtgagtactggaaactcctacgtaagatagtccgaacggagatcttttcaccaaaaatgctccaagttcaagagcacgtaagagaggcgaaggtggcagagttggttgagttcttgaaaggtaaggaaggacaagttgtgaggttaagtcagctggttttcgggacattgttgaatatattagggaacgtggtgttctcgaaagatgtgtttcgatatgcagatggagagaaagataaaatgcagaaattgatcaaagaaatgctgatgattggagctgaaccaaacttggctgagttttggccaattcttgaagaacttgatttacaaggattgaaaaaacgatgcaatgatcgatttctggaggtgatgaagatgtgggagggaactgtggaggagagaaaggtgaagaggaatgaagaagctaaggacatgttggatgttttacttgctaatgacttcaatgatgctcaaataaatgccttgttcttggaaacatttgggccgggttctgagactagtagtgcaacaatcgagtgggcattggctgaactcgtcaagaacccaaaaatattagccaaagttcgcgaagaattagacagagttgtcggggaatccacagtgaaagaatcacacctcccttacctcccttatctccaagcctgtataaaggagacaatgaggttgcacccagctgcacccttcctactccctcatcgatcggttgaggaatgcaacgtaatgggttacaccgttccaaaagactacgggatcctggtaaacgcttacgcaattggaagagatcctaattcatggaaagaccctacgacattcaagccagaacgcttcattgagtcggatattgattattatggtaaacactttcagttcttaccatttggttcgggaaggcgacagtgcgttggaatgcctctagcgactcgaaccataccgttgattgtgtctaatctagtgcacagaattgattggagtcttcccgatggcaagccagtcgaggagttggtcatgaatgagacgttaagcttgtcgttggctttagaccctacgctaactgtcgtcccgaaagtgagggtctaa

SEQ ID NO: 128 - DNA, 1512 bp, Nandina domestica
atgttcatgaaaatcatggaagaaaccattgcaatggaaggtatcaacttcttattccttctccttcttctcgttcttgtgctagttcttctttgcttcatttataagtacatcacatctccaactcttccaccagggccattctcatggcccatcataggcaatatccttgccataggaaagaggccccatgtttcactagctcagctagcccaagcccatggcccacttttctctctccgtctcggtgctcaacttgtcgtcgttggatcatccccggccgcagcccatgaaattctcaaagtccatgatcgattactatcggcccgatctataccaaatgcagcgcctgccaaaaatccggcctacacttattgttcggtaggatgggcagattgtaccgatcaatggaaatatctacgtaatatttgtggatcggagttgttttcgacgaaggccattgaatctcaatcaaaattgagggaggacaaggtgattgaattggtggaatttttgggtacaaaggaaggtcaagtggtgaatattggtgaagttgtgtttgctacagctttcaatatgttgagtaatattttggtgtcaaaagattttattaatttggaaggggagagagggggtgaagggatgaagggaattgtaaggacatatgtggaagtaggaatcactccaaacatagctgatttttatcccattttgggtgtatttgatcttcaaggcctaaagaggaaatctatggaatcttttgtgaaaatatgtggattctgggaaggtattatcaaagaaagaagagaaagcaaagatggggatgtttcaatgaggcaaagagacttcttggactatttgctttccattggatttaacaatgatcagattaatcacttactactggaattgttccttgcaggtgtagacactactactccaacaattgaatgggcaatggcagagcttataaaaaaccaaaaaactatgaaaaatgttcgtgatgaactcgaaagagagattaacaaaaattgtgttaacgaatctgatctcgttcgtctaccttacctacattcctgcattaaagagacgttgaggttacaccatcctggacctctatctatacctcgtcgtgcactcgaaacatgtaaggtgatgaactacacaatccctaaaggctctcaagtgtttgtaaatttatgggcaataggaagagaccccatgacttggaatgaccccttggtttttaaaccagaaaggtttctggacgcaagtgtggaatcgaactccagcggttttggatggataccatttggagctggaaggagatcatgccctggacaacctatggctaataagcaagttccattaattattgcgtctttgattaaacgcttcgattggtctcttcctcatgatatgaatccttctgagctaaacatggatgagacgtttggccttacattgcagagagaacaaccccttatcctcatccctaaagtaaagaaatga

SEQ ID NO: 129 - DNA, 1467 bp, Nandina domestica
atggaccttacaagtgcaattctcatcatcccatttttcgccatcccctttatactcatggctttcaaacttaaacacaagaacctcccaccaagccctcctggatggcctattctaggcaatctaccaaccctttttagccacggtaatgaaccgttgcacattacactcaccaacatggctcctacttatggccctttattacttcttcgattatgccaaaagcgtatcgttgttgcttcaacaaccgaggctgccatggaaatacttaaaacacatgatcgagctttatcaggcagagtaatcccatcgagcttccgcatagactaccacatcaaacactctattgtatggtctgactgcaatgatacttggaagaatatccgtaaaatcttgcgtactgaaatctttgcaccaaaaatgttacaagtgcaggagaagattagagaggggaaagtgagggacatgatgaacttcattagagggaaacaaggaaatgtggtgaatgtaaggcaatgggtgtttgggtgtttgttgaatatattggggcaggcagtgtgctcaaaggatgtttttgtgtatagtgatgatggagataaggtagggatgcagacattattgcgtgatatgctcatcaattcagggactccaaatatcggagagtatttcccaattttggatccccttgacttacaatggttgcgacgacaatgtaatcaactattcagacaaggggtcaaattgtgggaaggaacagtcaaggagaggagattgtgtaggaatgaggagtcgatggatatgttggacgtgcttcttgctaatgacttcaatgatgatcagatcaatgccctattcttggaaacatttgggcctggttctgagactagtagctcaacgatcgaatgggcattgtcagagctgataaggaatccagataaaatggcaaagctccgcaaagaactggatcagatagtggggaaatccacagtgaaggaatcacacctccctcacctcccctatctccaagcgtgtattaaggaaacaatgaggttgtacccaagtgcgcccttcctactccctcacaaagccgtcgagacttgtcaagtaatgggctacacaattcctaaaggttatggaatccttgtgaatgtgtatgcaatcggaagagatcctaaactatggaaagacccgttaacatttacaccggaacgattcctagagtgtgatgatatgaattacaatggaactaattttcagttcttaccatttggtgctggaagaagaatttgtgttgggtggcctcttgcagaaaggactattccattgatattgtcttcccttgtgcatggctttgattgggatcttcctgatggtaagcaccatgaagatatggaaatgaatcaagtgttacacatttcgctaaataaggatccaccactcgcagttatcccaaaaatgaaggcataa

SEQ ID NO: 130 - DNA, 2169 bp, Nandina domestica
atgttgctcaaattcggggtggaacctgttgtcgttgcatcgaccaatgaagctgccatgcaagtgctcaagacccatgatctagtatccggtcggttcgccccgaatagtgtgcaaataaagggttatattgaacactccatggtgtggaatgattgcaatgagtattggaaaaaggtaaggaaaatatggaaaacacaaatgttttccaccaaaatgttggatgcacaagcttttgttagagaggaaaaggtgatggaattggttgatttccttagaggaaaacaaggacatgtagtgaagtttgctgatttgatatttgggtgcattttgaatattttgggtgctgtcattttctctcaaaatgtttatgatttcgatgatacgagcgataatgagttgggtatgaaagggatgattcggcagttgatggtgttggctgcaataccaaatttagctgatctttatccgatactgggtagttcagattttcaagggttgaggaaggcctcagccgcatgtgttaagaggatgaatgagtactggggttcaatagttaaagaaagaaggaagaagaattgtcacttgaagaatgatttcttggatgtgttgctcaaagctgacttcagtgatcctcaaattgatgccatgctcttggaaatatttgggcctggttcagatactagtacctcaaccattgagtgggcgatggcagagttgttacgaagtcctgagaagctaaaaactgttcgaaaggaactcaataatgttgttcttggaactaaacaactgaaagaatcagatctacccaaccttccttatctaaatgccgtcgtcaaagagactctcagattgcaccctccagtcacattcctactccctcatcaggcaatagaagaatgtcaagtgatgggctacaccataccaaggggatgtccattgatggtgaacacttatgccattggacgcgaccctaaaacatggaaagatcccttgtcattcaaccctgagcgatttttattggacacggaaattgattatcaaagtggtaatgactttaagtacataccattcggcgcagggaggagaatatgtcctgggttgtcattggcagctagggttgtgccattcgtacttgcttcgcttattaacacattcgagtggagtttacctaatggaatggatcctagtgagctagacatgaaggacaagtttgggcttgcactcttgaaagwgktwyygcttttsatcactacactcttcttcctaacatcaatggcagggatttccacttcttcaaccaaaaggtgtgcagttgttacaggggctaacaaaggcattggattggagatatgtagacagttaccttcaaatggagtcttggtggtcttaacagctagagatgaaaaaaggggtgttgaagctgttgaaaatctcagacagtgtggactgtctgatgtggtttttcatcaacttgatttgatgaactcaactagtatygcttccttggcagaattcattcaaactcaatttgggaagcttgatatcttggtaaacaatgcagcaatccatggaactataatagacaatgatgctttaaaggctcagagccatgggaatgcttggagtgctttaacaggggctatggtacagacgtacgagttagcagaagaatgtattaacacaaactaccatggcaccaagggagtgaccgaagcacttcttcctctgcttcaactttccaattcagcaagaattgttaatgtttcatccaaaataggccaactagagaatatttccaatgaatgggctaaagagatgctaagtaatgttgacaatcttactgaagagaaaatagacgacgtgctgaatgagtttctaaaggactataaggagggactgttggagataaaaggctggccaattgctccttctgcctatagaatctccaaagctgctgtgaatgcctacacaaggattttagcaaaaaagttccctatgatcagtataaattgttgcactcctggttttgtgaaaacagatatgagtgctcatattgggagattaagtgttgaagatggagcaaaagctgtggtgatgatagctttgttgcctgatggtgggccttctggccttttctttgttcagaaagaagtagcttccttctga

SEQ ID NO: 131 - DNA, 1491 bp, Nandina domestica
aaatcatggaagaaaccattgcaaaggaaggtatcaatttctttattccttctccttcttgtgctagttcttctttgcttcatttataagtacatcacatctccaactcttccaccagggccattctcatggcccatcataggcaatatccttaccataggaaagaagccccatatttcactagctcaactagcccaagcctatgggcctcttatctctctccgtctcggtacacaacttgtcgtcgttggatcatctccggccgcagccatggaaattcttaaagtccatgatagattgttatcgggtcgatccataccagacgtaatacctgccaagaatccggccttcacaaaatgttcgttagcatggaatgattgtaccgatcaatggaagtatttacgtactatttgtcgatcggagttattttgtatcagggccatagagtcccaatcaaaattgagggaggacaaggtgatcgaattagtggaatatttgggtacaaaggaaggtcaagtggtgaattttggtgaagttgtgtttggtatagtattcaatatgttgagtaatatattgatgtcaaaagattttattaatttggaagaggaaggagagggtgaaggaatgaagggacttgtgaggacgttagtggaattgggaaccattccaaacttggctgatttgtttcctcttttgagtgtaatggatcttcagggtctaaagaaaaaatctacagaagcttttgtgaagatatgtggattttgggaaggtattattaaggaaagaagagaaggcagagacaaggatgttttaataaggcaaagagacttcttggactacttgctttccattggatttaacaatgaccagatcaaccgtttgctagtggaattgttacttgcaggtgcggacactactacttcaacaattaagtggacaatggtagagcttatgaaaaaccaagatgccatgaaaaaggtttgcattgaacttgaacgagaaatcaacgaaaatcgtgttaaggaatcggatctccatcgcctgccttacctaaattcctgcactaaagagacactgcggttacaccctcctgcacctctacttttacctcatcgtgctctcgaaacatgcaaggtgatgaactacaccattcctaaggacactcaggttttcgtaaatttatgggcaataggaagagaccccatgacttgggacgaccccttagtttttaaacccgaaaggtttctagactctaatgtggaatctaagttaaatgattttgggtggataccatttggtgctggaaggagaatttgccctggacaaccaatggcaatgaagcaagctgtgttaatcctcgcttctttgatcaaccacttcgaatggtctcttccttgtgacataagttcttctacactaaacatggatgagaagttcggtattacgttgcagaaagaacaacctctaatactcatccctatcataaagtga

SEQ ID NO: 132 - DNA, 1461 bp, Nigella sativa
atggagttcttttccatagccattgtttcctcattcttcttcctcttcctcatcttcattttacgcgattcacgacccaagaaccttcctcccgggcctcgtccatcaccgatcgtcggaaatcttctccaactaggtgacaagccccactccgagtttgctaaactatcacaaacctatggagagcttttcagcctaaaactaggcactcaaacagtagtagttgcttcctcacccgcagcagctacagagatactcaaaacacatgataaaaatctctctagtcgatatgtctttcagagctttcgggtaaaagaacacgtcgcaaactccattgtttggtctgattgcagtgagaattggaagctgttgaggaaaatatgtaggacagagttgttcactcccaagatgattgagtcgcaagcttatatcagagaggctaaggcattggatatggtgaagttcttaaagaagaaagaaggtgaagttgtgaagatagttgaagtagtgtttggtacacttgtcaatatttttggaaacttgatattttctaaggatgtttttgatttagaagatccaaatggtggaagtgctgagttgaagcaacatctttggaaattgttggagatggggaattcgactaatccggctgattattttcccttcttggggaagtttgatttatttgggcaaaggagagctgtcgcggaagttcttcaccagatttatgatgtctggggtgttatgttgaaggagcgtcgagccatgaatggcactgaaaatgattttgtgagtgttttgctcagttctggacttgatgaccagaagatcaatagcttgctcatggaactatttggtgctggcacggagacaagtgcatccacaattgaatgggctatagctgagctgacaaaaaacccaagtattgcatccaaattgcaatctgaattgttgagcattgtgggagatagggcagtgaaagaatcggatatacctagtctaccatacctgcaagcatttgtgaaggaaacactcagactacaccctgcgacgccattgctactcccgcgtcgtgctccaaacacatgtaaagtcatgaagtatacaattccaaaagattgtcagatcatggtgaatgcttgggccattggaagagatccaaaaacatgggatgatccactgagtttcaaacctgagaggtttttggattccaatttggatttcaaaggaaatgactttgagttgattccctttggtggtggaagaagaatctgccccggacttcctttggcaagtcaatttattagcttgttcatagcaactctggttcagaactttgattggagtttgcctcaaggagtaagtagtaatgacttaagcatggatgagaaatttggtctgacattacaaaaggatccacccctccttattgttccaaaacttagaatttctagtgtttaa

SEQ ID NO: 133 - DNA, 1461 bp, Nigella sativa
atggatgtacaagtagctttgttttccatcattccagccattcttgcttttctccttatctccaaattcaaaaacaaaaacttcccaccaggtcctccttcatggcctttaataggcagtatgccaattcttttcaacagtgtaaccccacttcacatcactctaaccaacatggctcgaacctatggtccaatgatgacattatggctaggtactcagcccactgtcatagcttcaacacctgaatccgccatggaaatccttaagacacacgatcgtgcttgttccggccgtcatattcgtatgagtttccgactgaaacaccacatcaaatactctcttgtttgggctgattgcactgactactggaaactcctgcgtaaaatagctcgaactgagatttttgcacctaagatgttgcaggcgcaatcacatgccagagaagagaaggttggtgagttgatagaatacttggggaggaagcaaggacaagcagtgaagattaatcagtttgtgtttggaactttgttgaatatattagggagcgtcgtgttttccaaaaatgtttttgaatttagtgatgatgatggagacaaagaaagcatgcagaatttgatcaaacagatgcttatgatcggagcagcacccaatcttgctgagttttatccatttctggaaacacttgatttgcaaggacttaaacggaggtgtgatgatcgattcactcaagtcatgaaattctgggaaggtactgtgaaggagagaagagagcgtaggaatgaagagtcaaaagacatgttggacgttctacttgccaatgacttcaatgattcccagataaatgcgcttttcttggagacattcgggcctggttctgagaccagcagtgctacaattgaatggacaatggcagagttgataaagaacccaaaggagatggccaaggtacgcaaagaattagacaatgtggtgggcagatctagtgtgaaagaatcccaccttcctgagcttccttacctccaagcctgcatcaaggagacaatgagattacaccctgcagcgcccttcctactccctagacgagcagttgagtcatgtcaaatcatgggctacaccattccaaaaggttgtcagatcctagtgaatgcttatgcaattggaagagaccctaaagcatggaaggagccagacagattccgaccagaaaggttcttggaaacagaggtggattaccatggtggacatttccagtacataccatttgggtcagggaggaggacttgcgttggaatggccttggctactaggacccttcccttgattgtagggtcattggtgaacacttatgattggggtctaccagatggaaagaagccagaggaactggaaatgaaagaaatgttgagcttgtctttggccatagatcccagcctacttgttgtgcccactctcagggcctaa

SEQ ID NO: 134 - DNA, 1479 bp, Nigella sativa
atggaaataaatctctactactaccttcttctgcttgttctgccccttatttttctcatcattaagcacatcaagtctgcaactaatcttccaccaggtccatttccatggccagtcataggcaacattctcagcatgggaactaaacctcatgtctcattagcccaactagctaaatcttatggtcctgttatgtcaatgagacttggtactcaaatactcattgttggttcttctcctgcagcagctacagaaattctgaaaacaaatgatagagtattatctgccaggaaggtggtgcacgcactgcctgcaagcccagatcggttgcatttctctgtaacttggtcagactgtactgatcaatggaagtatttgcgtacacttattagaactgagttgttttcagctaaagtgattgaatctcaaggacagatgagagaaaggaaggttagtgaagtcgtggagtttctaaggaccaaggaaggtaagcctgttaagattggagtgatagttttcaatactattttcaatatgttgagtaatttacttgtgtcaagagatttgattgatttgcatcaagagaatgaagatgaggggttgaaggggtttgttagaaaatttgtggagttgtgttcttgtccaaatttggcagattattataccatgttaagtggattagatcttcaaggattgaacaagaaagctaggaaaatgtttcaagagattagcatgatatgggaagttatcattaaggaaagaagggatgctcaatctcatggtaataatctttccagggagccagacttgcttgacaccatgcttgacagaaagctcaccaatgatcatatcagctacttgttcctggagttgtttttggctggaacggatccaagtacgtccacagtagagtgggcaatggcagagcttatgaaaaatccgaatgccttgaagatagtccgcagtgagcttgcaacagagataaatggttctgtaattaaagagtcagatctttcacgcctaccgtacctacaatctgttgtaaaggagacactgagattacaccctgctgcgccattcctgctgcctcatcgtgctcttgaaacatgtaaggtgatgaactacacagtgcctaaagattctcaagtgtttgttaatatatgggcaattggtagagatccaaatgtttgggaagaacccatgagtttcaaaccagagagatttcttaatcagtctcataatgatctgaattctactaacattccgttcataccattcggagctggaagaagaatttgtcctgggcagccaatggttgctaaacaagttcctttggttcttgcttctttgatcaattgctttgagtggtctcttccacatggtgtccatcctacagatcttgatatggaagaagcttttggtatagttttgcagaaggacaaacctttgattctcattccccaagttatattgcaatag

SEQ ID NO: 135 - DNA, 1470 bp, Nigella sativa
atgttagaaatggattactactattatcttcttctgcttgttctgccccttgtttttctaatctggaagcacatcaagcctccaactaaccttccaccaggtccgtttccatggcctgtcataggaaatattctcaatctgggaaacaaacctcatgtctcactagctcagctagcagaaacctacggtccagtcatgtctttgcgactaggtactaaactcctcatcgttgcatcatctccagctgcagccactgagattctcaaaacccatgatcgtatattctctggtcgaaccatacctcatgcaatacctgcatatcctgatcgaattcatttgtcaatgggatgggctgactgcaccgatcaatggaaatttcttcgcaccctttgtcgaactgagttgttttctgcaaaagcaattcaatcacaagcaaatattcgagaggacaagatgaaggaattggtgatgtttctagctaccaaggaaggacaaagtgttaagattgaagaagttgttttcaataatatcttcaataccttgagtaatttatttttatcaaaagacctaatgagtttgcaggaaggtgatcagttgagaaattttgtgagaacatttatccaattgatcttcacacctaatttggcagattattatagcatattaagtggactagatcttcaaggtctgaacaagaagtgcaaggaaatgattgaaaagatatgtggtgtgtggggggttatcatcagagaaagaaggcaagaagataaagatagtggtgttacaagaccaagagacttctcggacagtctgatccacgctgggctcacagatgagcaaattaactacttatttatggagttgtttttcgctggtgcagatactagtacctcaacaattgagtgggtgatggcagagcttataaaaaatccacaagttatgagaaaagtctgcggtgaacttgagagtaggaagaaagagactgtcattataaatgactctgatctgccctatctaccatacctccatgccactgtcaacgaaacattaaggttgcatcctccagcaccatttctcattcctcatcgtgcaattgaaacatgtacgataatgaattatacaatccccaaagatgctcaagtgtttgttaatgtatgggcactgggaagggattcaaagacatgggaggaccccatgagttttagaccagagcgatttctcgagtctggtattgacataaactcaggtgatttcagattcataccgtttggaggtggaagaagaatatgtcctggactaccacttgcagctaaacaagttcctttactagttgctaacttgatcaattgctttgattggtctcttccgcttgacatggaacctgctcatctatgcatggatgagaagttcggtataactttgcagatggaaaaacctctagttctcgttcccagaaagaagaaatggtag

SEQ ID NO: 136 - DNA, 1454 bp, Nigella sativa
atctctactactaccttcttctgcttgttctgccccttatttttctcatcattaagcacatcaagtctgcaactaatcttccaccaggtccatttccatggccaatcgtaggaaatattctgaatatgggaaacaaaccccatgtctctctatctcagctagcagaaacccatggtccacttatgtctttgcgactaggtactcaactcctcatcgttgcatcatctccatctgcagccactgagattctcaaaacccaggatggaatactctctggtcgaactgtacctcatgcaatacctgtaagtcctgatcgacttcatttgtcattgggatgggccgactgcactgctcaatggaaatttcttcgcaccctttgtcgaactgagttgttttctgcaaaagcaattcaatcacaagcaaatgttcgagatgacaaggtgaaggaactggtgatgtttctagctaccaaggaaggacaaagtgtgaagattgcagaagttgtttttaataacatcttcaatacgttgagtaatttattattatcaaatgatcttgtaagtttgcaggaaggtgatcagttaagaaattttgtaagaacatttatccaattgatctccacacctaacttggcagattattacagcatattaagtggactagatcttcaaggtctgaacaagaaggccagggaaatctttgaaaaaacgtgtggtgtatgggaggttatcatcagagaaagaaggaaggagggagaaagtggtgggtcgagacaaagagacttcttggacagtttgatcaacagtgggctcacaaatgatcaaatcaactacttgttaatggagttatttagtgcgggtacagacacaactacatcaacagttgagtgggcaatggcggagcttataaaaaatccacaagttatgagaaaggcccgtcttgaacttgaaaatgaaataaaagagactgccattataaaagactctgatctgccatgtctaccttactttcgcgccattgttaacgagacattaaggttacatcctcctgcaccgttactcctccctcatcgtgccactgaaacatgcaagctaatgaattatatcatccccaaagatgctcaagtgttggtcaatgcatggaaaataggaagagactcaaagacatgggaggaccccatgagttttagaccagagcgatttcttgagtctggaatggatttgagctctagtaatttcaaattcataccatttggagctggaagaagagtatgtcctggactaccagtcgcagctaggcaagttcctatactagttgccaacttgatcaatttctttgattggtcccttccacttgacatggaacctggtcatctatgcatggatgagaagttttcaataacattgcagatggagaaacctctagtcctcattcccagcgtgaagaaacggtaa

SEQ ID NO: 137 - DNA, 1464 bp, Papaver bracteatum
atggagatagtcacagcagcacttatagcaattgtgatcactactttcttatacttaatttttagagattcaagtcctaaaggcttgccaccaggtccaaaaccgtggccaatagttggaaaccttcttcaacttggtgagaaaccccattctcagtttgcagaacttgctaaaacctacggtgatctctttacactgaaattagggagtgaaacagttgttgtagcttcaactccattagcagctagcgagattctaaagacgcacgaccgtgttctttctggtcgttacgtgtttcagagtttccgcgtgaaagaacatgtggagaactctattgtgtggtctgaatgtaatgatacatggaagaagttgcggaaagtttgcagagcggaactttttacacagaagatgattgaaagtcaagctgaaattagagaaagtaaggctatggaaatggtggagttcttgaagagaaatcaagggagtgaagtgaaaattgttgaagttgtatttggcacgttggtgaatatatttggtaacttgatattttcgcaaaatattttcaagttgggtgatgaaagcagtggaagtgtagaaatgaaagaacatctatggagaatgctggaattgggtaattcgacgaatccagctgattattttccatttttgggtagattcgatttgtttggacaaagaaaagatgttgccgattgtctgcaagggatttatagtgtttggggtgccatgctcaaagaaagaaaaatagccaagctgcataacaacagcaagaagaatgattttgttgagattttgctcgattccggactcgatgaccaacaaatcaatgccttgctcatggaaatatttggtgcggggacagagacaagtgcatctacaatagaatgggcgttatctgagctcacaaaaaaccctgaagtaacagccaatatgcggtcggaattgctatctgtggtagggaagaggccggttaaggaatccgacataccgaacatgccttatcttcaagcttttgttaaagaaactctacggcttcatccagcaactccgctgctgctcccacgtcgagcactcgagacgtgcaaagttttgaactatactatcccaaaagagtgtcaaattatggtgaacgcctggggcattggtcgggacccaaaaaggtggactgatccattgaagtttgcaccagagaggttcttgaattcgagcattgatttcaaaggaaacgactttgagttgataccatttggtgcagggagaaggatatgtcctggtgtacccttggcaactcagtttattagccttattgtgcctactttggtacaaaattttgattggggattaccaaagggaatggatcctagccaactgatcatggaagagaaatttgggttgacactgcagaaggaaccacctctgtacattgttcctaaaaatcgggattaa

SEQ ID NO: 138 - DNA, 1467 bp, Papaver bracteatum
atggagatagtcaccttagcagcactaatagcaattgtgatcaccagtttcttctacctaattcttagagattcaagtcctaaaggcttgccaccaggtccaaaaccctggccaatagttggaaaccttcttcaacttggtgagaaaccccattcacaatttgcccaacttgctggaacctatggtgatctctttacactcaaattagggacccaaacagttgtcgtagcttcaaccccattagcagccagtgaaattctaaagacacatgatcgtgtcctctctggtcgatacgtgtttcaaagtttccgcataaagaatcatgtgcagaactgtatggtttggtctgactgtaatgaaacatggaagagtttgcgcaaagtttgtagaacagaactctttacgcggaagatgattgaaagtcaagctgaggttagagaatgtaaagctatggaaatggtggaatatttgaggaaacatcaaggaaatgaggtgaaaattgttgaagttatatttgctacactagtgaacatatttggtaacttaatattttcacaaaatattttcaagttaagtgatgaaaatagtggaagtgtggaaatgaaagaacagatatggagattgctggaattaggtaattcaacaaatccagctgattattttccatttttgggtagcttggatttgttgggacaaagaaaagatgttgctgatagtctgcaagagatttatggagtttggggtcctatactgacagaaaaaaaactagccaagcaacataacaccaatacgacgaatgattttgttgatcttttgcttgactctggacttaatgatcaacaaatcaacgcctttctcatggaaatatttagtgcgggaacagagacaagtgcaactaccatagaatgggccttagctgagctcataaaaaaccctgagttaacagccaatattagatcagaactgctgtctgtgttaggcaagaggacggttaaggaatccgacatacccaaccttccctaccttcaagcttttgttaaagaaactctgcggcttcacccagcaactccattgctactcccacgacgggcacttgagacgtgtcaagttttaaactatacaattccaaaagggtgtcaaataatggtgaacgcctggggcattggcagagatccgaaaacatggaccgatccattgaagtttgcaccagagaggttcttgagttcgagcattgactacaaagggaacgatttcgagttcataccatatggcgcagggagaaggatatgccctggtatgcctttggcaactcagtttatcagtcttattgtgcctactttggtacagaattttgatttggggctaccaaagggaatggatcctagcgaactcatcatggaagagaaatttgggctgatgcttgagaaggaaccacctctgtatattgttcctaaaactcgggaataa

SEQ ID NO: 139 - DNA, 1530 bp, Papaver bracteatum
atgatggcgttggagaattctattcgagagagaaagagagaaaataagattaagatggatattgtcaccttagcagcacttatagcaattgtgttcaccattttctttttcctcattcttagagattcaagtcctaaaggcttgccaccaggtccaaagccgtggccaatagtcggaaaccttcttcaacttagtgacaagccccattcacacttcgcccaactcgccaaaacctacggtgatctctttacaatcaaattaggaaccgaaacaattgttgtagcttcaacctcaatagcagctaccgaaattctcaaaacccatgaccgtattctgtcgggtcgatacgtgtttcaaagtttccgagtaaaaggacaagtaaagttgtctatgacttggtctgattgtaatgacacgtggaataaattgcgcagaatttgtaaagtagaacttttttcacaaaagatgatcgaaagtcaggctgaaatcagagaaagtacggctttagaaatggtggaatatttgaagaagaaggagggaagtgaagtgaaaatgagtgatgttatatttggaacggtaatgaatatgttcggaaagtcgatattttcacaaaatattttcgagttaggtgatgaaaatagtggcagtctcaacatgaaagaacgtatacggagactgatggaacttggtaatacaaaaaatccagctgattattttccatttttaggtagttgggatttgcttggacaaagaaaagaagttgccaattgtcttcaacgtgtttatgatgtttggggtgttgtgcttaaagaaagaaaaatattcaatatgcagcataatagcaagaagaagaatgattttgtggatgttttacttgatgctggacttgaagatggacagatcaattccttgataatggaaataataactggaacagagacaagtggatctacaatagaatgggctgtcgctgagctcacaaaaaatcctcaagttgcagccaagatgcgatcagaattgctatctgtggtagggcagaggccaatcaaggaagctgatatacctaacatgccctatcttcaagctttttctaaagaaactctacggcttcacccaccaactccattgctaatcccgcgtcgagcacttgagacttgtaagatcttgaactatacaattccaaaagattgccaaataatggtgaatgcctggggcataggtagagatccaaaaacttggactgacccattgaagttttcaccggagaggttcttgaattcgagcattgatttcaaagggaacgattttgggtatataccatttggtgcagggagaaggatatgtcctggtatgcccgtggcaattcagtttcttagtcttattgtgccaactttagtacagaattttgattggggactaccaaatgaaacggatcctacccaactgattatggaagagaaatttgcgctgacactgcagaaggaaccaccactctatatcgttcctagaactcgggatccatccgcttaa

SEQ ID NO: 140 - DNA, 1467 bp, Sanguinaria canadensis
atggagattgtcacagtagcacttatagcagtagtaatctcttccatactctatcttcttttccgtgactcaagtcctaaaggtttaccaccaggcccgaaaccgtggccaattgtaggaaacctcctccaactcagtgacaaaccccacgcacaattcgccgaactggcccaaacctatggagatctctttacactacgcatgggaactcaaactgtcgttgttgcctcaaccccttcggcagctaccgaaatcctaaaaacccacgatcgaattctctccggtcgttacgttttccagagttttcgagtaaaaggccatgtagaaaactcaattgtttggtcagaatgtaatgatacttggaaaaatttaagaaaagtttgtagaactgaacttttcacacagaagatgattgagagtcaagctcatgttagagagagaaaggcttgggaaatggtggaatatttgaagaagaaagaaggtgaagaagtgaagattgtggaagtgatttttggaacacttgtgaatatatttgggaatttgatattttctgagaatatatttgaattgggtgatccaagtagtggaagtgtggaaatgaaggaatatttatggaggatgctggaattggggaattcaacaaatccagctgattattttccgattatgggtaagtttgatttgtttggacagaggaaagcagttgcagagtgtcttcaggggatttatgatgtttggggggctatgcttaaagaacgtaaagctgcgaagaaggctggaggtagtgaaggaaagaatgattttgttaatattttgcttgattctggactcaatgatcaacagatcaatgccttgctcatggaactatttggtgcgggaacagagacgagtgcatcaacaattgagtgggccataactgagctcaccaaaaacccaaaagtaacggccaaaatccgatcagagctactgtctgtggtgggccagagcacagtgaaagaatctgatatacctaaccttccttatctccaagcttttactaaagaaaccctacgacttcacccaccaactccattgctactccctcgtcgggcactcgaaacatgtcaagttatgaactatacgatcccaaaagaatgccagatcatggtgaatgcgtgggccataggacgagaccccaaaacttggaccgatccattaaatttctcaccagagcggttcttgaattcaagcgtggacttcaaaggtaacgattttgagttgataccgtttggtggagggaggaggatatgcccgggtgtaccgttagcaactcagtttatcagtcttattgtgggcactttggtacaaaattttgattgggacctaccaaatggaatgagtcctagagatttgaaaatggaggagaagtttgggttgacactgcagaaagaaccacctctgtgtattgttcctaaatcaagggcttga

SEQ ID NO: 141 - DNA, 1467 bp, Stylophorum diphyllum
atggagattgtcacagtagcactcatagcagtagtaatctcttccatactataccttacctttcgtgacacaagtcctaaaggtctaccaccaggcccaaaaccgtggccaattgtcggaaacctccttcaactcagtgacaaaccccatgcccaattcgccgaactcgctcaaacttatggagatctctttacactacggatgggaacacaaaccgtcgtcgttgcctcaaccccaaaagcagctgccgaagtcctaaaaacccatgatagaattctctccggtcgttacgtttttcaaagtttcagagtaaaagagcatgtaaaaaactccattgtttggtctgaatgtaatgatacttggaaaagtttaagaaaagtttgcagaacagagctttttacacagaagatgattgagagtcaagctgaagttagagagagaaaggcttgggaaatggtagaatatttgaagaaaaaacaaggtgaagaagtgaagattgttgaggtgatttttggtacccttgtgaatatatttgggaatttgatattttcacagaatatttttgacttgggtgatcctagtagtggaagtgtggagttgaaggaacatttatggaggatgttggagttggggaattcaacaaatccagctgattattttccaattatgggtaggtttgatttgtttggacagagaaaagaagttgaagattgtcttcaggggatttatgatgtgtggggtgctatgcttaagaaacgtaaagctgctaaggaggcaggaaaaagtgaaggaaggaatgattttgttgaaattttgcttgattccggtctgaatgatcaacaaatcaacagcttgctcatggaattgtttggtgctggcacagaaacatccgcatcaacaatagaatgggccataactgaactcaccaagaacccaaacgtaacagccaagatgagatcagaattggaaactgttgttggccataacacagtaaaagaatctgatatacctaatcttccttatctccaagcttttgttaaagaaagcctacgactgcacccaccaacaccattgttgctaccacgccgagcacttgagacatgtcgagttctaaactacacgattccaaaggagtgtcagatcatggtgaatgcgtgggctatagggcgagaccctaaaatatggaccgacccgttaactttttcccctgagaggttcttgaattcaagcattgactttaaagggacagattttgagttgataccatttggtggagggaggagaatatgccccggtataccattggcaactcagtttattggccttattgccgctactttggtgcagagttttgagtgggacttaccaaatgggatgagccctaaagatttgaacatggaagagaagtttggattgacattgcagaaggaaccacctctgtacattattcctaaatcaagggattga

SEQ ID NO: 142 - DNA, 1464 bp, TCRCYP80-1
atggagataataacgctatcaataggtttcattttcttcatcatcttcatcttctacttcttcaacaaccagagctcaaaaggcctacctccaggccccaaaccatggccaattgtgggaaacctactgcaactaggagaaaaaccacatgcccagtttgcacaactctctcaagaatttggagatctcttcacactaagacttgggtctcaaacagtagtagtggcttcatcaccagctgcagccacccagatcctcaagacccacgacagaattctctctggccgatacgtcttccaaagctttcgaatcgataagcacgtgaacaactcaatcgtatggtcagaatgcaatgacaattggaagatgttgaggaaagtgtgtaggacagagattttcactgcaaaaatgatagagtcacaagctcatgttagggaagctaaagcaatggagatggttaagttcttgaggcatagggaaggggaggttgtgaagatagctgaggttgtgtttggaacactagtgaatatctttgggaatttgatattctcccaagatgtttttgacttgagtgatcctagtagtgggagtgcggagatgaaggagcatatttggaggatgttggagttgggaaactctactaatccagccgattattttcctatcatgggcaagcttgatttgtttgggcagcggcgagctgtcgaggaatgccttcaacagatttacgatatttggggagttatgttgaaggagcgtcgcgctaggaaaggaagtgaaaatactcatgatttcgttaacgttttgcttgaagccggacttggtgatcagtgcatcaactccttgctcatggaattatttgcagcgggaacagaaacaagttcatcaacgatcgagtgggctatagcagagctaacaaaaaacccaagaataacaactaaactacgccaagaattgcgagacgtgattggggaagagagggtgaaagagtcccatatccctagcttaccttacctccaagcctttgtgaaggaaacactaaggctacaccctgccaccccaatgcttctcccacgtcgagctctcgaaacatgtaaagtcatgggctatgttatcccgaaagattgccaaataatggtgaacgcttgggcgattgggcgagacccaaaagtttggaaggatccattgacgttttggccagagaggtttttgaattcgagtttggattataaaggaaattattttgagttcataccatttggaggagggaggagaatttgccctggatttcctttggcttctcagttcataagtataattgtggctactttggttcaaaatatggattggtgtctccctaatggaacggatcctagtgagttggtgatggaagagaagtttggtttaacactgcaaaaggagccatctcttcttctagtttttaaatcaagagatttgaaataa

SEQ ID NO: 143 - DNA, 1482 bp, TCRCYP80-2
atggatccaaccgtagcattaatcttgtgcctagtcattcctgtcatccttctcatctcctttctctacaaacccagaaacctcccaccaggccctcacgcatggcctctcgtaggcagcttgcccgcagtactaagcagcggtgcaccgcttcacatcacccttaccaacctggctcgaacccacggcccgttaatgctggtcaccctcggaacccaacccaccgttctggcctcaaccagcgaggcggcaatggaagtactcaaaacccatgaccgagctctatcaggccgtcacatacgcatgagctttcgcttgaaagaaatgaacaagtgctctcttgtgtggtcaaactgcacagattactggaaactgttgaggaagattgcccgaactgagattttctcacccaggatgttgcagattcaagagcacgttagagagaggaaagtgggcgaactggtggagttcttgagagggagaaaggaagggaaagcagtgaagattagcgagtttgtgttcgggacgctgttaaatattattgggaatgttgtgttttcgaaagatgtttttgggtttgatgacgaaggaggagataagatagggatgcagagtttgatacgtgagttgttgatgatcggagcgagtccgaacgtggcagagttctatccgattcttgaagggttggatttgcaagggttgaagaggaggtgtagagaccgagttaaccgagttaacaagttgtgggagacgaccgtgatggaaagaaggaagaagaggagtgttgctgaagggtgggagtccaaggacatgttagatgttcttcttgataataactttgatgacgttcagatcaacgtcttattcctggagatgtttggtcctggttctgaaacaagtagcgcaaccatagagtgggtgctagccgagctgatcaagaaccctgataaaatggccaaagtccaaaaagaattggaaaaattagtaggaaacaagggttcccaagtgaaggaagctcacctccccgaccttccctacctccaagcctgtgttaaagagacaatgcggttgcacccagctgcaccgttccttctcccacaccgcgccgttgagacctgccaagttctgggttacactattcctaaggactaccaactcctagtgaacgcttatgccattggaagggaccctaatacatggaaggaccctacaagcttctgccctgaacgcttcttggactccagcgtggatttctatgggaaccattttgagttcataccctttggttctgggagaagaatttgcattggaatgcccttggcaactcgaaccgtgccattgatcgtggcctctttggttcacaattttgattggagcttaccagatggaaaacgtcccgaggaactggtcatgaatgagatgctaagcttgtcactatctatagatccaagtctttctgtcgtcccaaaaacgagagcttag

SEQ ID NO: 144 - DNA, 1479 bp, Xanthoriza simplicissima
atggaagttctttctattgctattgtttccttcttgttcctcctcttcctcttcttcattttacgcgactctcgccaaaagaaccttcccccaggaccacgtccatcaccaattgttggaaatcttctccaacttggggacaaaccacacgctgagtttgccaaactagcacaaaaatatggagaacttttttctttgaaactaggctctcaaacagtagtagttgcttcatctccagctgcagcagctgaaatcctcaaaactcatgataaaatactctctggtcgatatgtatttcaaagctttcgggtaaaggaacatgtcgagaactcgattgtttggtctgaatgcaatgaaaactggaagttgttaagaaaagtttgcaggacagaattgttctcacctaagatgattgaatcacaagctgggataagagaagccaaggcaagagaaatggtgaagttcttgagaagtaaagaaggggaagtagtgaagatagttgaagtggtatttggaacacttgttaatatctttggaaacttaatcttttcgaaagatgttttcgacttggaagatcctactggtgggagtgctgagctgaaagaacatttatggaaattgttggatatgggaaactcaacaaatccagctgactattttccaatcatggggaagtttgatttgtttggacaaagaagagcagtggcagaggttcttcaacaaatatacgatgtctggggtgttatgttgaaggagcgtcgaggtaggaaagtaagtgaaagtaacaatgattttgtgaatgtcttgatcaatgctggactcgatgaccagaagatcaatgccttgcttatggaaatgtttggtgcaggaacggagacaagtgcatcgacgatagaatgggcaataactgaactgacgaaaaaaccacccgttgcgtccaaaataagattggaattggttaatgttgttggtgacaacacagtcaaagaatcagatttgcctcatcttccatacctccaagcttttgtcaaggaaacactcagattacaccctccaacaccattgctacttccacgtcgtgctcttgaaacatgtaccgtcatgaactacaccatccctaaggactgtcaaatcatggtcaatgcttgggctataggaagagatccaaaaacatgggatgatcccctgaatttcaagccagagaggtttttgagttctgatgtggattacaaagggaatgattttgagttgataccatttggtggtggtagaagaatttgcccagggcttcctttggcaagtcagtttattagcttaattgtggctactttggttcagaatttcgagtggagtttacctcaaggaatgagtactagtgagttgagcatggatgagaaatttggattgaccttacaaaaggatccacctctcctgattgtcctaaaagctagggcttccaatgatctcagttttatttga

SEQ ID NO: 145 - DNA, 1494 bp, Xanthoriza simplicissima
atggaagaactaattgtagtgctaagagaaacaaatctcctctactatatttccctcattgctttaccccttctctttctaatcctcaagcaaatcaagtctccaagtaaccttccaccaggaccatttccatggccaatcgttggcaacattcttaatatgggaagcaaacctcatatttcacttgcccaactagcaaaatcccatggtccactcatatctctacgactaggaactcaactagttgtagttggatcatctcaggccgcagccaaggagattctcaaaacccatgaccggattctgtccgctcgatgtgtaccccgagtgatccctgtttatccagatcaactccatttatcaatggcatgggtagaatgcaatgatcaatggaggtacttacgcacactttgtcgaacagagttgttttcagccaaaatgatcgagtcacaagcaagtgtgagagataagaagactaatgagttggtggagtttttagctaataacgaaggtaaattagtgaagattggagatgttgtttttgccactgtttttaatatgttgagcaatatatttgtatcgaaagactttattagtttggaggaagagagtgaggatggtggaatgaagggacttctgagaagatttatggagttgggatctgctccaaatttggcagacttctataccatattaagtggattggatcttcaaggtataacaaagaaatccaaagaaatgttagggcaggtcaatggtgcgtggggcgttatcacaaaacagagaagggcggataaaggtaatgatgttttaaggcaaagagacttcttggatagcttgcttgacagtgaactcgacgacgatcaaatcaactacttgcttcaggaattgttccttgcaggtgcagacactagtacctcaacagttgagtgggcaatggtagagcttataaaaaatccaaaggccatgagaaaagtttgtgctgaacttgagagagagaccagtggacacattgtcaaagaatcggatctgcctcgtctaccttatttacattttacagtaaatgagacactaagattacaccctcctgcaccatttctccttccccatcgtgccctagaaacatgcaaagtgatgaactacaccattcctaaagactgtcaagtgctggttaatgcatgggcgattggaagagatcccaatacttgggaagaccctttgagttttaaacccgagcgttttcttgactcaggtatggacttgaattcaggtaacttcaaattcatcccatttggtgctggaagaagaatctgtcctggactgccaatggctgctaaacaagttactcttattcttgcttgtttaatcaactgttttgaatggtcgcttccacatagcatgcttccgagcgagctagacatggatgataaatttggtataacgttgcacaaagagaaacctctgctcctcattcccaaagtaagaaaggcgtaa

SEQ ID NO: 146 - DNA, 1461 bp, Xanthoriza simplicissima
atggatctccaaattgcactgttttccttaattcctgtcatccttgttttcatacttctcttaaaacctaaatacaagaacctcccaccaggtccccatccatggcctttcataggtagcttaccaatcctttttaccaatactgaagtaccacttcacattactctagccaacatggcacgtacccatggcccactaatgatcctatggctgggtactcaacctacggtcatggcttcaactgctgaagccgcaatggaaatcctcaaaacacatgatcgtatcttctctgctcgtcacattcgtatgagttttcgactaaaacaccacattaagtattctcttgtgtggtcggattgtactgattattggaaactactacgtaaaatagtgagaacagagatattttcacctaaaatgttgcaagcacaatctcatgttagagaacaaaaggtggctgagttgattgagttcttgaggagtaaagaaggacaagtagtgaaaattagtcaatttgtctttgggacattgttgaacatattagggaatgttgtgttctctaaggatgtctttgtttatagtgatgaaagtgataaaggagggattcaaaatttgatcagagagatgcttatgataggagcagaaccaaatgttgcagagttttatccgatcctggaagaactagatttacaagggttgaaaaagaagtgtgatgacagattcatccgagtcatgaagatgtgggaaggaacggttacggagagaaaggccaaccggaacgaggagtccaaggacatgttggatgttctacttgctaatgacttcaatgatgctcagatcaatgctcttttcctggaaacattcggacctggttcagaaactagcagtgcaacaattgagtgggtgatagcagagctcatcaaaagcccgaaagaaatggcgaaggtgcgaaaagaattggatgaggtggttggtacttccactattaaagagtcagacctccctcaacttccctaccttcaagcatgtatcaaggaggcaatgcggttgcacccagctgcacccttcttacttcctcgtcgagcagctgagacatgcgaagtcatgggctacaccattccaaagggctctcaagtcttggtcaatgcttatgcaattggaagagatcctaaatcatggaaggacccaacaattttccgaccagaacgtttcttggaatccgatgtggatttccacggagctcattatcagttcataccatttggttcaggaaggcggacttgcgttgggatgcctttggctactcgaactattccactgattgtgggttctttggtgcacacttatgatctgggtcttccaggtggaaagcgccaccaggaactggaaatgaatgaaatgctaagcttgtcattagctatagatccgagtctttgtgttgtaccaaaagcaagggcctaa

SEQ ID NO: 147 - DNA, 1599 bp, Argemone mexicana
atggataattttcttctccagttccaaccaatttcaattgcagctttttttgttgccctagtttttctgtattggagttatggaagaaaaagcaacaaaaccctaaaaccaagagcaccagaagcagcaggaggaagaccaataacaggtcatcttcatcttttttatggagaagaattaactcatcgaaaactaggttccatggctgataaatatggaccagttttcaatattagatttggttcacataaaaccctagttgtaagtaattgggaaatcgttaaagaatgtttcactacaaatgatcgattattctcaaatcgaccaggtactttagctattaaactaatgttttatgatactgattcagtaggttatgcaccttatggaaattactggagagaattaagaaaaatttcaactttaaaacttctctctaatcatagaatagaaaccctaaaacatttaagaacttctgaagttgaatcctgttttaaacagctttataatcaatgggaaatgaaaaatgaaaacagggtagaagttgataaattagggtttgcttcagtaaggatggataattggtttggggatttaactttcaatgttgtagcaagaattgttgctggaaaaaagaattttgcaggaggtgcagtaaatggtgatattggagctcagagatataaagtagccatggatgaatcttttagattaatgctaacatttgcatattcagatgtgattccatcactgaaatggttagacaaattaagaggtttaattagagatatgaagcgttgtggatctgaaattgattcaattgttgctagttgggtagaagaacatcgtttaaagagaaattcttctgaaaataataatttagatcttgaagaagattttattgatgtttgtttggatattatagagagttcttcattacctggtgatgatccggatactgtcatcaaatctacttgtctggatatgatattgggtgggagtgataccacgacagtaaccctaacatgggccatctccttaatattgaacaatcctcacgtgttgaaaagggcaaaagaggaattaaattccgtagttggaaaagatcgacgtgtagaagattcagacatccctcatcttacatacatccatgcaatcatcaaagaaaccatgagactctaccctgctggaccactgatcgaaaggaggacaatggaagattgtgaagtaggtgggtaccacgttccagctggcacacgtttattggttaatgtatggaagatgcaaagagacggggatgtgtataaagacgatccattggtgtttagacccgagagattcatgactagtaatgctgatgtggatctaaagggtcagcattttgaactgataccattcggtgcgggtcgcaggatatgcccgggtgtgtcatttgcggttcagttgatgcatttggtattggctcgtcttctacatgagtttgaaattactacaataccttctgaaccaaaggtagatatgtctgaaagtggaggattaatctgtcataagataaagccactagaagtgctaatcaaaccccgactcgagctgaactaa

SEQ ID NO: 148 - DNA, 1614 bp, MECYP82-2
atggatttctcatcaatactactacttctcaatattaattgcttcacaacttccttggtcacccttcttgttcttgtcatggtttttctctacaataatacaagatttactaaacccaaaggtaataaaaagatgattaaaccacccagactacccggtgcacgccctcttttaggtcacctccatctgtttggaccaggtgagcttcctcacaaggttctctcaaccatggcagataaatacggtcctgcctttacaattaagttcggtaaacacacaacattagttgtgagcgatatccataccataaaagaatgtttaactactaatgacatcctcttttctaaccgtccttcttctatagcctttgatctcatgacttacgctgatgactccgtagctttcgcacattatagtccttattggcgtgagcttagaaagatatctactctcaaacttctatctaataaccgtcttcaatctatcaaacaacttcgactctctgaggtgaacgtatgttttaaagaactatatagtttatgcaacaataataataaaagtggagctccggttttgattgatatgaagaaatggttcaaagaggtcacgactaatatagtcattagagttattgttggtaaacaaaattttgggtctaagattgtgcgaggcgaagatcaagaagctgccaattacaagaaaatcatggatgaactttcacgccttgctaaattgtctatgttctctgattatgctcctttacttagtttgtttgattacttccgaggaaacgtgagtgctatgaaaagaaatggtaaagaattaaacgcgatgcttcagaattggttggaagagcataagaggaagaagaactcatcaatatcgaacgatgatgaacaagatttcatggatcttatgttgtcaattattgacgaaactaagctatacggacgtgacgctgatactttcattaaagctatttccctttctatgatcgtgggtggaatagacaccgttgtcgtgactctaacatggattctcgccttaattatgaagaatccttttgctttgaaaaaggctcaagaagagttagactttttcgtcggaaaggaaagacaagtagaagattcagatctcaagaacttggtatacatgaatgccatcgttaaagaaacgctgcgattatacccattaagttgtattcttgaacgtgatacgaaggaagactgtgaagttggtggctactacgtcgaaggtggcacacgtttactaataaacgcatggaagttacaacgggacccgaatgtatggacagacccttcggaatttaagccggagagatttctaaatgagaatgcagacatagatgttggtggccaacattacgaattaataccatttggagctggtagaagagtgtgtcctggtgtatcttttgcactccagtttatggatttggttctggctcgtctcatccatgggtatgaattgggaactctaaatggtgaagatgttgacctaactgaaaaaactgaaggacaaattaatttcaaagcaacccctctggatctcatcgttactcctcgtctccaccccaatctttatgattattag

SEQ ID NO: 149 - DNA, 1569 bp, Berberis thunbergii
atggaatcaattgagtttctagtaactctgctactcagcctgcttgccctattttgtgcttatgcatggaagaggaaaaaccatacaaaggatagcaaaatcaaagagccaccccaaccagccggagcatggccgataatcggccaccttcatctaatatcccgcggcggccttcctcatataaacatgggggccatggcggacaagtacggtccagttttcatgatccggctaggagtaaatcgagctgtgattgtgagtaacacggagatcgtcaaagagtgcttcacaaccaacgataaattcctactaaaccgtccagttgggttagccttaaacctcatgtgctacaacaacgccatgttcgggttctgtcggtacggtccatattggcgagagatacacaaaatagtcatgcttgagctcctctcgaacagccggctcgagtccctgaagcacgtatgggactcggaaatatcgacatccatcgaagagttgtaccaattatgtcaaacacaaaacaagacccatgaaggcccagttttggttgaaatgaaggattggtttgcagatatggcactcaatgtgtcccttagaatgattgctgggaaaagatactttggtgcaagtgccggtggtaataaagatgaggcaagaaagtgtcaaaagaccataagagatttctttagacttgttggcttgtttatagtgtctgatgcacttccatttcttaggtggctagacttgggagggcatcagaaggagatgaagagaacatttgaagatcttgactatatgcttcaaggatggttggatgagcataaattgaatagaaaatctggtgtgaatggtgatcaagatttcatggatgtgatgttatctattcttgatgattcaaaatttccggattacgacgttgacaccgtcaacaaggctacgtgcttccaattgatcataggaggaactgatactacaacggtcactctaacatgggccctttccttgatgttaaaccacccacatgtattgaaaaaggcccaagatgagttggacatccaagtaggcaaacacagacaagtggaggaatcagacatcaagaacctaaaataccttgaagctgtgatcaaagaaaccttacggatgcgcccagtaggcccactgttaggcccacgagagacgatcgaggactgcaccattggtggatatcgagttcgagcaggcacacgtgtaatggtcaatgcttggaaggtgcatcgtgacccatcggtttggtcaaaccctgatgacttcaaaccggagaggtttctcaagaaggatattgacttcagggaccaaaactttgaattcatccctttcgggtccggtagaagggcctgccctggaatatcatttgccgtggaagtactgcccatggctttggcccgtttactacatgggtttgagcttaagactcaattgggttgcaaggtggatatgacagagcatgccggtttagttcatgctaaagctacccctttggaagttcttgtcagcccacgcctgtctcgagagttgtatgtatcgtcttag

SEQ ID NO: 150 - DNA, 1543 bp, Berberis thunbergii
gggatcacttgctctcattgccattattattctttccaacattgtcaaaaaatcttcgaaatctctttccagtaaaggtggcaagagtgcacccgtggttcatggtgcgtggccagtcatcggtcacctgcacctactgatgggtaaggagttgcctcatcatgcattagccaaactggctgataagtacgggccagccttcacactcaacattggcgcgtatcaagaactagtgatcagtactcgggatcttgcaaaagaatgtttcaccaccaaagacaagttcttcctaaatcgtccaagcaataaggccatgaagatcctgacatatggtgaagcatcagttgggttcgcaccatatagcccactttgggtcgaaatgcgcaaggttacgaaatctaatctcttatctcaccaaagggtcttgatgcaaaatcgttcacgagcatcagaaattgatgcaagttttaaacaactatatgaacaatgcaatgggaagagtggagcttcggtggaaatgaaaaactggtttgaagaagtgatgttgaatgtggttactaggaatgtttctgggaaaagaagttttggtaccaaggcaagacttggtgatgcagaggccgtgaagtataaaagggttattgatgagaccgcacggtttatggggaaccttgtgatctcagatatggttccaagtctttggtggttggataacatgttgggtgctgagagtgctatgaagaaacttgccatagaattggattctctacttggtggttgggtggaggaacatagagggaagaagttgagtgacgacgaggagggggactttatcagtcttacatgggagatgatcgatcagattcagcttcatggtcttgcccctgagacgttcatcaagtctatgtgtgtcggcgtgctgttgggtgggagtgataccacatcagtagccctaacatgggcactctcgctaatgttgaacaatcgcgaggtgttgaagaaggcccaagaagaattggacttccacgtaggaaaggaccgcaaagtggacgactcggacctcaagaatcttgtttacttacaagccattatgaaggaaacaatgaggatataccaagtaggtcctctaattgaacgagaggccgttgaggactgtgaagtgggtggattccaaatcaagaaggggaaccgtatactagtgaacctgtggaagttgcaacgtgaccctgaagtgtggtcagatccgtccgaatttcgacctgaaagatttcttgaggataagtctaaggtggacttgaagggccaaaatgctgaactaatgccgtttggcagtggtcgacgtatgtgtccaggagtttggtttggggtgcactccacttctttggtacttgctcgtctcatccaagggtttgaaatagagacaccactggatgcaaaagttgacatgacggagacatcaagtgtgaccaattataagggaagtcctcttgaagttattgctcgactccccggctcgaacctaagctttatgatttgtagttatgta

SEQ ID NO: 151 - DNA, 1638 bp, Corydalis chelanthifolia
atgactccctcaatttcacaaccttttgagcttcttcttcttctgatgacaatggagtctcttcttctccaatggcaaccaacttccattgctgttcttcttctcgccatcacaattttcctctacaccttcacaaaatcaccccctaaaacccacaaaaaactagccccagacgcaacaggaggacggccattaatgggtcatcttcatctcttcaattcaaacgaattaacacatcgaactctaggatccatggctgataaatatggtccagctttcaacattcgattcggttcacacaaaaccctagttgtatctacttgggaaatcgtcaaagaatgtttcaccaccaacgatcgatcattctcaaatcgcccaggaactctatacatcaaactcatgttctataacgaagattcagtagggtatgcaccttatggagcttactggagagatcttcgtaagctatcaacactgaaactactctcaaaccatcgattggaatcattgaaacatttgagggtttctgaaatgaatgaatgtttcaaacagctttatgagatttgtaacaaaggaagtaaatctgttgctgttagaatggataattggtttggtgatttgacttttaatgttgttgcaaggattgttgcagggaaaaggaattttgcttcaattagtaatgatgttggagctatgagatataagaatgcaatggatgaagcttttagattgatgactgttttttcattttctgatgtgattccatcacttggttggttggataatttgagaggattagtgggtgatatgaaaaaagctgggaaagaaattgattcagtggtttcaggttggattgaagaacatcgtgagaagagaaagagaagatcatctggtggtaataacagagatggagaattagaagaggaggatttcattgatattactttgtctatcttggaaacttcaagtctccctggtgatgatcctgacatgactatcaaatctacttgcttggatatgatcttgggtggtagcgacactacaacggtgactatgacttgggctctctccttgctattaaacaatgctcacgctttgaaaagagcaagagaagaactggacttgcacgtcgggagagatagacaagtggaagattcagatatcaacaatttggtctacatccaagcaatcatcaaagaaacaatgagactatacccagctggacccctcattgaacggatgacaaaggaagattgtgaggtaggtggattccacatcccagccggaacacgtttgttagttaatctctggaagatgcaacgagacccaaatgtgtgggaggatcctttggaatttcgacctgaaagattccttaccaacaatgcagaaatagatctaaagggtcagcatttcgaactcatcccatttgggacgggtagaaggatatgcccaggtgtttcatttgccttacaattgatgcatttggctctcgctcgtttacttcacagttttgaagttgcatcccccatggatgccaagattgatatgactgaaaccgcaggccttataagccacaaggtaattccgctagaagtcctcatgactccacgccttgactctaagctttatgattattag

SEQ ID NO: 152 - DNA, 1572 bp, Corydalis chelanthifolia
acacacacaaccgaaaagaatttaccaccggaagtgcctggtgcattgcctgtcatcggtcacctccacaagttaggtggtcggaaaggtcttctaccatatcatgttcttggagccatggctgataagtacggacctgccttcacattccagtttggttctaaccgaacccttgtgattagtaattgggaaatggtaaaagaatgtttcacgtctaccaacgataagttattcgcttatcgtccaacagcattgttcaataaggaagtattctgtagtgaccattcttttggattcggaccttatggcccgttctggagggagatgcgtaaggtttgttcgcttcatcttctctccaattatcgcctcgagctcttaaaacactctcgaaaatccgagatggatgagtgtttcaaggagttgtaccaactatggagtgcttcaaatattagcaaagacaagcaacctgctgttttggtggtggaaatgaagaaatggttcgaagatgcgatgttcaatgttgcttcgagagttgtggtgggaaaaggaagtttgaaatctcatgagaaggctggagggagtgataatgaagtagcgaggaacaaatataagaaaggcatggatgaggctagacgacatatgggaacatttgttatatcggataggatcccgtttctttggtggattgattatttacggggtatccatagttctatgaagcgaacggcgaaagaccttcatgccattgtagagacgtggttagaggaacaccgtcttcattgtcacaaacggagagtattgcaactcgatgccaaccatgaggttgaagatatggcgaaagaggaagaaaaagattttatggatgttttattgacgatggcggacgagggagccatcaaaatctttgaccatgatcttgataccgttatcaaagctaattgtctggatatggttatcgctggaaccgatacaccaaccgtaatgcttacatggaccctttcactattactaaacaatccagatgttttgaaaagagttcgagatgaactggatttacatgttggaaaagaaagacaagtagaagaatctgatgtcaagaatttggtctatctccaagcagttttcaaagaaaccctgcgtttatacccagctgtacctctaaatgaacgtttgacaatggaggattgcaatgttgggggttacgatatcccagccggtacccgtctattaatcaacatttggaaggttcaaagagacccaaatgtgtggcaggatccctcagaattccgtcctgaaagattcttgagtaaggaaaaatccaccatagatgtgaggggtctagattttgaactcattccattcgggacaggtagacggatgtgcccagggatttcattttccctccagctcatgcatttgggactcgctcgcctcattcacggctttgaattagcaactccgatggatttggatgtcgacatgtctgcaaatcctggagctttcaactataaatcaaccgatcttcaagttcttgttagcccacggtttcattctaagttctacggttgttaa

SEQ ID NO: 153 - DNA, 1611 bp, Corydalis chelanthifolia
atggatttccttgctcttcaatggttcccagcttccttgactgcccttcttgccttggctgtcctttacaacttctggaccaagcaaaggacttacaagaatggaaagacgagtactaaacaggcacctgtagctgccggtgcatggccagttcttggtcaccttcacttgtttggtggaggtgaactgcctcacaagatgcttgctactatggctgataaatatggacctgccttcacaatgaagtttggtacacatcaaacactagtagtcagtaacaccaagattgtaaaagaatgtttcacaaccaatgatactttgtttgcaaaccgtccatccaccacagcctttcacctcatgacctacgataacgagtcggtagccttcacaccatatggtccattctggcgtgagctgagaaaaatctcaacactcaagcttctttctaaccaccgtctccaagcaattaaggatgtacgtgcctcggaagtgaatgtgtgcttcagggagttgtacagtcaatggaggataaataaaagcgagcctgaaaccagtgatcatcagggtccaattctggttgatatgaagaagtggttcgaagaagtctcagacaatgtggtgcttagagtgattgcagggaaacaaaactttggctctaagattgtgcatggagacaaagaggcccttcactacaagaaaatcatggacgagatactacgtcttgcggcagtttccatgctttcagatgtggctcctttgcttggttggttagatatgttccaagggcatttaagtgccatgaaacgaaatgcgaaagaggtagatactatgctatgtaactggttggaggagcatcgaacgaaaagactctccagcgatcatgacggtgtagagcaggatttcatagatgtcatgctgtcaatcgtggaggagaacaagttctctggccacgacaatgataccgtaatcaaagctactgtcttggccatgatcatgggtgggactgataccaccgctgtcagcttaacttggattgtgtccttgttgatgaacaaccgccacgttttgagaagggcacaagatgaacttgacttgcacgtggggaaggatagacaagttgatgattcagatctcaagaacttggtttatctcaatgctatagtcaaggaaaccatgcgtttgtacccattaggtgctcttcttgaacgtgaaaccaaggaggattgtgaggttggtggtttccatgtcaaaggtggaacacgcctattagtgaatgtatggaagctacaacgagacccaagcttttggaccgatccaacagaatttaaacctgaaagatttttagcagacaaggcgaacatagatgtcggtggtcagcattttgaactactgccatttggggctggtagaagagtgtgcccaggagtctcgttcgcactgcaattcatgcatttggtacttgctcgtctacttcacggatttgatttggctacccctatgaatgcagatgtcgatctaaccgagagtactgaaggacatgtcaaccagaaagcatcccctctcaatctacttgtcactccacgtctccattctaagctttatgaatactag

SEQ ID NO: 154 - DNA, 1632 bp, Corydalis chelanthifolia
atggagtacacattctcatcagcctcattgttctcctcctcctcccttcaacaatggctctcaacccttctacttctaatttcctccatcaccatttctctttaccttactcgtcgcggtaagtcatcaccgccaatggtccctggagcatggccactcattggtcacctacatttacttggtgggaacgatccacttcatatcgttcttggaaccatggctgataagtatggacatacctttgccatgttattcggtaaacatccatcacttgttgttagtagtagtgacattgtaaaggaatgtttcacttctacaaacgataaattgttttcgcatcgtcatgttcctaccggagttaaatacatgttctacaataatgactcgtttggttttgcaccttacgggccttattggcgtgaaatgcgtaaaatgaattcactttctcttttctcacaccatcgcgttgaaatgcttaaccgaattcgaacatctcaaattaacatttggtttaaaaacctatatgaaatgtgtaccaaggagaagagtactagtacaagtagtgatggagttgtggttgaaatgaagtcatggtttgatgaaatgtttttcaatgtacttgtgaatatgattgttaaacctattaatgatgatgaagagttggtgaagaaatacagagaagtggcgaccgaggcaggacgcctattgtcaagcatggctgtttcggatatggttccatctctaggatggttggatcatttgtttgggattgtgggtaaaatgaagaaaactgcaaaagatatggatgctatcctcactacttggttagaacagcataagatcaaatctcaacagctgaggagaagtaatggaggagaaggtgctgctgatcaaacagaggaggaggagaaggagggaaaagggctcattggtgatttgttgtctatgcaagagtctgctcttttcggccatgaccgagacactgtcatcaaatctgcttgccaggcgttgatcatggctgggagtgacagtacatcagccacattaacatgggttctctctttgttactgaaccatcgtgacgcactcagaaaggctcgagaagaactggatcaagttgtaggaaaggacagacaagtagatgattcagacattaaggatcttgtatatctccaagccattttaaaggaaacgatgcggttatatccagctgcaccgatattagagcgcttggcagtagaggactgcattgtaggtggatttcatgttcaagcaggcacaacactgtttgtgaatgtcagcaagctgcaacgtgacccaaatttatggacggatcctttagaatttaaacccgagagatttctcaccggctgtaacgcggatgtggacttgaagggtcaagattacgagctcgtgccttttggttcgggtagacggtcatgtcccgcggtatcgtttgcagttcgtgtaatgcttttggtacttgcacgcttcattcactcatttgaagtgaagactcgtgaagaagatgggattttggatatgactgagagttcaggtcacaccaattgcaggtctagcccactggaagtcctcatctcaccacggttggattcgaagatctactgttga

SEQ ID NO: 155 - DNA, 1587 bp, Corydalis chelanthifolia
atggagtactactcatcactaccatttcttcaacaatggccactttcatctatatcatcatcaccaacttctattgctacaacacttctcattgtagcttgtttcaccattgttttcctctacataaacaccagttctaagtccaataacaacctgaaatcaccaccgaaacttcccggtgcatggccattcatgggtcacctacatttactaggtggaaaccaaccagctcatgtcagtcttgcaaacatagcagagaagtacaaatcgactcccttcatgatccgaatgggtcaacattcaaccctcgttgttagttcggttgatctcgtaaaggaatgtttcaacaatacaaatgataagctgttttcgaatcgtagtatcgcaagaggaattagagatatgttttacgatatggaatcgtttgggtttgcaccttatggttattactggcgtgaactacgaaaagtatctgcccttactctgttctctactcatcgtgttgattcggttatccaaattaaaacacctcaaatcgacggttggtttaagaaactttacgagcaatgtacgaatacgaaaggcggaattgttgaaataaaatcatggttggatgaaatgatgtttgatgttcttgtgaagatgcttgttgaacctaaggatgaaggatctgtggagaaatacagacatgtagcaggggaggctttggaagtgctggggaatatgagcatctatgatttagtacctagtcttggttggttggatcacttcactgggcttgtgaagaaatataaggtaactggtaagaaaatggacactatcctcaacagttggttagaagaccatcgaggtgagaaagtagctgaggaacacaagggtttaattggtaagttgttgtcaatgaaggaaggatcaaagcttcttggccatgatggagatactgccatcaaatctactgttcaggtgttgatcctaggtgccggcgatagtgcaggagcaactttaacatgggcaatctcattattattgaaccatcctcacataatggagaagcttcggaaagaactggatgcagccgtaggaaaggatagacaaatcgaagactcggatgtgaaaaaattcacttatctactagccatattaaaagaaacaatgcgattatacccggtgacaacgcttctacaacgggaaacgatggaagattgtgctataggtggatatcatgttgctgctggcacaagactgatggtaaatgtttggcaggtgcaacgtgacccgaatgcgtggtcagatcctttggagtttaagcctgagagattcctaactgagtgcgcgcatgtggatttctcgggtcagtattctgagcttattccattcggaacaggtcgacggatatgcccagctcttacgctatcggttcggctcatgttattgacccttgcccgtattatccattcgtttgatgtgaaaattcctaatggggcatcgagtgtggatatggcaacaagcgtaggttttgttaatctgaggttgaccccacttgaagtcgaactctcaccacgcttggattcaaagatctacggttga

SEQ ID NO: 156 - DNA, 1614 bp, Corydalis chelanthifolia
atggattcctctcttcttcaatggtacacaacagcttcaatggctgcccttcttgccttagctttcttctacaaactctggagtaagccaaggacttctaaaaatggaaaaagtactttgcaggcaccagtagcagctggtgcatggccagttcttggtcaccttcatctgtttagtggaggtgagttaccacacaaaatgttggctgccatggccgacaagtacggccctgccttcacaatgaagttcggtacacaccgaacccttgtggttagtgacacaaagattgtaaaggaatgtttcactaccaatgatacgttatttgctaaccgtccatccaccatggcctttcatctcatgacctatgacaatgagtcggtagccttcacaccatatggtcaattttggcgtgagttgagaaagatctccacactcaaacttctttctaaccatcgccttcaggcaatcaaagatgtacgtgcctcagaggtgaatttttgctttaggacgttgtacaaccaatggaggataaataaaagtgagactatcggaaccggtgatcatcaaggaccaattttggtggatatgaagaagtggttcgaagaagtgtcaaacaatgtggtgatcagagtaattgtaggcaaacataactttggatctaagatcgcccgcggaaagggagaagcccttcactacaagaaagtcatggacgaggtcctacgtctagcggcagtgtccatgctctcggatgtggcccctttacttggttggttcgatcatttgcaagggcatgtaagtgcaatgaaacgaaatgcaaaagaagtagacactttgctctgtagttggatggaggaacatcgaaaaaagagaacctccaacggcagtaatggtgtagagcaagatttcattgatgtcatgctgtccatcgtggaggagaacaagttctctgggcatgacagtgacactgtcatcaaagctaccgtcttggccatgatcatgggtgggactgatacatcagccgtgagcttaacttggattgtctccctgttgatgaacaatcgccacgttttgagacgggcacaagaagaacttgacacacatgtgggaaaggatagacaagttgatgattcagatctcaagaacttggtttatctcaatgctatcgtcaaggaaacaatgcgtttgtacccactaggcgcccttcttgaacgggaaactaaggaggactgtgaggttggcgggttccatgttaaggctggcacacgtctattggtgaatgtatggaagctacaacgagacccaaacttttggattgatccaacagaatttaaaccagagagatttttaactgacaacgcaaacatagatgttgggggtcagcattttgaactgctaccatttggtgccggtagaagagtgtgccccggagtctcattcgcattgcagttcatgcatttggttcttgctcggctaattcatgggttcgaattggatacccctatgaatgcaaatgtcgatatgaccgaaagtacagaagggcatgtcaaccataaagcatccgctctcgatctccttatcacaccacgcctccggtctacactttatgattattaa

SEQ ID NO: 157 - DNA, 1716 bp, Corydalis chelanthifolia
atgttcaagtctgttccaagtgcacaggcaattttacwyaarctttcattcatccaccagtacttcctgctctctcaaacaaatatggattcccttctttttcaatggtttccagcttcaatggctgcccttgttgcctttgcttttctttataagctttggagtgcacccaaaattaccaaaaatggaaagacaagtactaaacaggcacccatagcagccggtgcatggcctgttcttggtcacctccatcttttcggtggaggtgaattgcctcacaaaatgcttgcaggcatggctgaaaaatatggtcctgccttcacaatgaaatttggtatgcatcgcacactcgtggtcagtgataccaagatcgtaaaggaatgtttcactacccacgatactctctttgctaaccgtccatctaccacagcttttcaccttatgacctacgatcaagagtcggtggccttcaccccttatggtcctttctggcgtgaactacgaaagatctccacgctcaaattactttctaaccaccggttacaagcaatcaaggacgttcgaacctctgaagtaaacgtttgctttagagggttatacaacatatggcaaaccaacaaaaatgagcaaggtggtactgttagtgatcatccacgccccgttttgattgatatgaagaaatggttcgaagaagtttcgaataatgtggtgattagggtgattgccggtaaacaaaactttgggtctaaaattgtacgtggtgaagaggaggcagtaaaatacaagaaaatcatggatgaagtcctacgccttgcggcagtatctatgctttctgatgtagctcctttacttggttggttagatcttttccaagggaacttgagtgcaatgaaaagaaacgcaaaagaagtagataatatgcttaatgcttgggtggaggagcatcgaagaaagaggctcgcacatagtgctaaagttgaggctactcatgtagaacaagactttgttgatgttatgttgtccatcatggaggagaacaagctttcatcagtccacgacgatgacactgtcatcaaagccactgtgttggccatgatcatgggtgggactgataccacagctgtgagcctgacctggacagtttccttgttaatgaaccatcgttatgtgttgaagaaggctcaagaagaaatcgatcaacatgtgggaaaagaaagacaagttgaagattcagatcttaagaacttggtttatcttaatgccattgtcaaagaaactatgcgtatgtacccgttgggtgctcttcttgaacgtgaaaccaaggaggattgtgaagttggtgggttccatgtcaaaggtggaacacgtctattggtgaatgtttggaagttacaacgggatccaaatgtttggattgatccaacagaatttaagccagagagatttttggcagagaatgccaacatagatgttgggggtcagcattttgaactgctaccatttggtgctggcagaagggtgtgccctggagtttcattcgcactccaattcatgcatttggttcttgctcgcttaattcatggatttgaattggaaaccccaatgaatgccgatgtcgatctaactgaaagtaccgaaggccatgtcaaccacaaagctagccctctcgatctgctcatcgccccacgactcaactcgaagctttatgaattgtag

SEQ ID NO: 158 - DNA, 1602 bp, Corydalis chelanthifolia
atggattccttgtttgttcttcttcaatggttctcagcttcattggctgcagttcttgctttggcttttctttataacctatgggttaagccaagaattagtgatggtaaaggaaataaagggagtactaaacaagcacctgttgcagccggtgcgtggcctgttctcggtcaccttcatctctttggtgggagtgaattacctcacaaaatgcttgcagccatggctgataagtatggacctgccttcacaatgaagttcggtacacatcgaacacttgtggtcagtaacacccaaatcgttaaggaatgttttactaccaacgatacacacttttccaaccgtccgtccaccacagcttttcacctcatgacttatgacaacgattcggtagctttcacaccttatggtccattttggcgtgagttgcgtaagatctctaccctcaagcttttatctaaccaccgtcttcaggcaattaaggatgtacgtgtttccgaggtgaatgtttgcttcaaggatctatacaatcaatggaagacgaatcaaaaccaacgtccggtcttggtggacatgaagaaatggtttgaagaagtatcaaacaatgtggtgattagagtaattgtggggaaacaaaactttgggtctaagattgtgcgcggtgaggaggaggctgtcaaatacaagaaaatcatggatgaaatcctacgccttgcggcagtgcctatgctttcggatatggcccctttacttggttggttggatcttttccaagctcacaagagtgcaatgaaacgcaatgcgaaagaagtagacaacatgcttgaaagctggctggaggagcataaaaggaaaagactatctggtgtaaatggtgcagaggaggaagatttcatggatgttatgttgtcaatcatggaagagaacaagttcactggacgtgatagcaatactgtagtcaaatctactgtcctagccatgatcatgggtggaaccgatactacagccgtgagcttaacttggattttctccttgttaatgaacaaccgtcatgcactgaaaaaggcacaagaagaattggatatgcacgtcgggaaagacagacaagttgaagattcagacctgaaaaacttagtttacctcaatgctatagtcaaggaaaccatgcgaatgtacccactaggtgcacttcttgaacgtgaaaccaaagaggattgtgaggtaggtggataccacgtccgcgcaggcacacggttgttggtgaatgtatggaaactacaacgagacccaagcttttggactgatcctacagaattcaaaccagagagatttttaaccgagaacgcaaagacagatgttggtggtcaacatttcgagctactaccatttggagcaggtagaagggtatgtccaggagtctcatttgcacttcaattcatgcatttggttattgctcgtttgattcacggttttgaattgggtactccaatggatgccgatgttgacttaaccgaaagtactgaagggcatgtcaaccacaaagcaactccactcgatctcctcattgccccacgcctcgactcaaaagtttatgattactaa

SEQ ID NO: 159 - DNA, 1593 bp, Chelidonium majus
atgaggagtaattacttaaagccgacgacgacgacgatcgaggataaaagtaagaacaagataagcaggaagaagccaatagcagcaaaaccaccacctgaagcattgggcgcatggccagtgatcggtcactttcttctatttacagggaaagggttgactcatgtgactctaggagacatggcggataaatacggaccagcatttcttattcggttcggtagccatagaacacttgtggtgagtagttgggagatgatgaaggagtgtttttcggcccctaacgataagatcttttcaaaccgtgaatccaacttattatggattaagtcaatgttctacggttccaattcatatgggttctcaccttatgggccatactggaaggagctacgcaagatatcgacccaaaagcttctctcccaccaccgacttgatgcgatgaagcacttgcagatggtagaagttgatgcctcatttaaacagatttacaatttatgcaacaaaaatggaggttcaccatcacctagtagtattaatactactgctctggtgaacatggacgaatggttgtcacacctgatgttcaacgtgatagcaagaatggtcagtggataccaatccgatgatgtcgggacaggtgctacgagtactggggaaagattcaaggtttccatggatgagacgatgcgtcttatggccattttcgctgtttcagatttggttccatggcttgcatgtgtggatcgattaagaggccttacgagaaaaatgaaccgttgtggtaaggatttggactcgataattgggagactaatcgaagagcatcgtcaaaagagacgattatgcagaaataataaaggatcaaaaaatgaagatggcggtcatgatgatgatcaagacttcattgacatttgcttgtcaattatggagcaatctcagcttcctggcgataaccctgaaattgccatcaaatccattgtgctagacatgatatttgctggaagtcacaccacgactctggcaatgacgtggaccctctccttattgttgaaccatcgccacatgttgaaaaaagccaaggaagaaatagatgcacacgtgggtaatgaaaggcaggtggatgactcagacatccataatcttgtgtacattcaagccatcatcaaagaatccatgcggttgtacccgcccagcccactgttcgaacggatgacaatggaggattgtgaggtaggtgggttccacattccagctggcacacgcttatttgtcaatgtatggaagatgcaacgagacccaactgtgtgggaggatccattagagtttcgacccgaaagattcttgacgagcaagagagagatagatgtgaaaggccagcattatgaactcataccgtttggtgcgggtaggcggatatgcccgggcgcgtcatttaccttgcaggtgttgcatttggtgcttgctcgccttatccatggcttcgaaatgacgacgcccatggatgtaaaagtggacatggcgtcaagtgcagggctattcagtaacaagatgacgcctttggaagtgctgatcacaccacgtacagcctag

SEQ ID NO: 160 - DNA, 1674 bp, Chelidonium majus
atgaagatattgcaggagtttcatcaactcaccatttccaatattgttcttcttctacttatttctttcatctttttctctcttagtgcatggttcattgagagtactaattattattacagtagtaagaagaagaagagcaaaaagacaccaccacctgaggcatcgggtgcatggccagtgataggacaccttcatcaatttaaaccggacgatttacctcatgaggctcttggagacatggcggataagtacggtcctgtttttattgttcgattcggtagttatagaaaacttgtggtgagtaattcggagatggttaaggagtgtttcacggccgcaaacgataggtccttttcgaaccgtccggccgtcttagggattaggatcatgctctataacaccataacgtatgcgttcgcaccttatggaccgtactggagggagttgcgtaggatatcgtcgcagaatctcctctctaaccatcgagttgatatggtaaagcacttgcatgtcgatgaagttaataccttgtttaaacaactttacgagttatgcaacaaaaatggaggtcgaccccctactggtactaatactagtactagtgctgctctagtgaacatggatgactggttgtcaaacataatgttcaacgtgatagcaagaattgtcaatggaaacaacaaatccattaataatgagaggacaggtgccataaatgagaaaagatacaaaacagctatggatgaggcgaggcgtcttgtggcaatttttgcagtttcagattcagttccatggcttggatggttggatcgagtgagaggccttataagaggaatgaacctttgtggaaaggaactagactcaattattgaagatataatcgacgagcatcgtcaaaagagacgattatgcacaagtaaattaggatcatcaggagatgatgatgctgataatagtaatcttgaggaagaagataacttcattgatgcgtgcttgtcgatcgaggagcaatcgcagttacctggcgaaaatcctgaaatcgtcatcaaagctttgatcctggacatgtttgctggtggaagtgatggcccacattttgtgttgacgtggaccctcgccttattattgaaccacccccacgtgttgaaaaaggcaagagaggaagttgatgcacacgtggcaaacgatagacacgtggatgtctctgatatctctaatctcgtctacatacaagcaatcctcaaagagtcaatgaggttgtacccgcccaacgcactcattgagcgaatgacaacagaagattgtgaggtaggtgggtaccacattccagctggcacatacctattggttaacgtatggaaggtacaaagggacccgaccgtgtggcaggatccctctgagtttcgacccgaaagattcttattaacaaacacaaaaacggagatggagtatgaacatataccgtttggtgcgggtaggcgaagatgcccaggaatgaggtttgcattgcaggtgatgcatttggtgcttgctcgacttattcatgaattcgaaatcacgacacccgtggatgtaataaaagtcgacatgacggcaactaatgggttattcaatcacaaggccgtgcctttggaagtgctactcacaccacgtactcttatccgaggttag

SEQ ID NO: 161 - DNA, 1626 bp, Chelidonium majus
atggattattcagtccttctccagtacggctggtttgctccttccatggctgcccttcttgccttagctttcctttacaatctctttttggcttcatctccgaaagctactagcaagagaacaataagtacaaagaaaccgcccatggcagccggtgcatggccaattcttggtcatctccatctgtttaaagagggtgagttgcctcaccaaatgcttaaatccatggctgacaagtatggtcccgccttcctcatgaagttcggccaacaccgatccctagttgtgagtgactaccgcatcgtaaaagaatgttttactactaatgatacccacttttgcaaccgtccatccactacagctttcgatgtcatgacttacgctaatgaatcggtagctttcacagaatacagtccttactggcgcgagcttagaaagatatccactctcaaacttctctctaacaaccgtctccaggccatcaagaacctccgagaagaggaggtgaatgttagcttcaaggggttgtatgattcatggaagaataagaacaacaagagtaccggcagtgttggtgatgaacgagctccggttttggtcgacatgaagaaatggtttgaagaggtgtcaaacaatgtggtgattagggtaatcgtgggcaaatgtaattttgggactaagatcgtgcaaggtgagaaggagggtgtagagtacaagacaatcatggatgagcttttacgacttgctagtttgtctttgttatccgattttgcccctatacttggtttgttggatttcttccaaggtcatgtccgtaccatgaaacgaaatggcaagaaactagacgtgttacttcagaggtggttggaggagcataagaggaagaagagcacaccagaggatgagcaagacttcatggacgttatgctgtcggttattgaggagagcaagctttctggctatgacgctgataccgtcattaaagctacttgtctggccatgatcatgggtggaacagacacatccgcagtgagtctaacatggatcgtctctttactgatgaacaatcgtcatgcactaaaaaaggctcgagaagaattggacgcgcaggtggggaaggatagacaagttgaagattcagatctaaagaacttggtttacttgaatgccatcgttaaggaaacaatgcgattatatccactaggtactcttcttgaacgcgaaaccaaggaggactgtgaggttggtgggtttcacctcgaaggtggtacacgtttactagtgaacgtatggatggtacaacgagacccaagcgtgtggactgatccgacaaagttcacaccagagaggtttcttacggagaaggcagacatagatgtttggggtgggaattttgaacttataccattcggagcgggtagaagggtgtgccccggagtgtcctttgcacttcaattcctaaatttggtactagctcgtctcattcatggatatgaattgggaactccagatgacgcggatgtggatctaacggagagcccagaaggacatctcaatcacaaagcatcacctctcgagcttctcctcaccccacgcctcagtaaccctaagctctatgattattag

SEQ ID NO: 162 - DNA, 1614 bp, Chelidonium majus
atggagtttctctctctagaaccccaactaatttccatttttgttcttcttcttgcttcatccatattcctctacaatctcttgaagaatcatggaaggaaatccaagacctcaaaaccaccagcacctgtagcatcaggtggatggccaatcatgggtcatctccatcttttcaatggaagcgagttaactcatcaaactctaggttccatggctgacaaatatggtccagctttcaatatccaactcggttctcatcaaacactcgttgtgagtagttgggagattgttaaagaatgtttcactacaaacgaccgattcttttcgaatcggcctggatcgttagcgattaaactcatgttctacgacgctgattcagttggttacgcaccgtacggtgcttactggagagatcttagaaaaatctctacgttaaaactcctttcgaatcatcgagtggaaaccctaaaacatttgagaacttctgaagctgaatcatgttttaaacaactgtataatcagtggaagaacaacaaagttggcggcgacgacgatgaatttgctatagtgaggatggataattggtttggagacttgacatttaacgttgtggcgagaattgtcgccggaaaaaagaattttgctggaggtgcgacgagtggcgacgtcggagctaagagatataaggaagctatggatgaagcgttccggttaatgacgattttcgcgttctcagatgtggttccgtcgttaggatggttggataaattgagaggtttggttggagggatgaagcgttgtggtgcggaaattgattccattgttgggggttgggtggatgaacatagattgaagagagcttctagaaagggaggagatcataatgatctcgatcttgaacaagattttatagatgtttgcttggagattatggaacattctactttgcctggtgatgatcctgaaattgtcatcaaatctacttgtctggacatgattttgggtgggagtgacacaacaacggtgaccctaacatgggcactctccttactattgaacaatcctcacgtattgaaaagggctagggaggaattggacacacacgtcggaaaggacagacaagtagacgactccgatatgtctaatcttgtgtacatccaagcgatcatcaaagagacgatgagattgtacccagcaggaccactgatcgagcgaaggacatcggaggattgtgaggtcagtgggttccatgtaccggcgggcacacgcttaatggtgaacttatggaagatgcaacgagatgggagcgtgtataaggaggatccattggagtttagaccagagagattcttgactagcaatgctgatgttgacctaaagggacagaattatgaactgataccatttggtgcgggtaggaggatatgtcctggtgtgtcgttcgcagtgcagttgatgcatttggtgcttgctcgtcttgttcatggctttgaaatgaagacggccggaggtgcaaaggttgacatgacagaaagtgcaggactaattagccacaaggttacaccgctacaagtgctgctcaaaccacgccttgcgatccaacaagctttataa

SEQ ID NO: 163 - DNA, 1653 bp, Chelidonium majus
atggattcgatgaacctgtttcaacaagcgattgcagtaggtacccttgtcatcttcctctactatctatggaagtggacatcaataatattcactcgaactcaccaggcggcgccaccagaacctgccggagcatggcctattataggacacctccatctcctagcaggaggagcaaaccaactcgtatatcacatacttggatccatggctgacaagtacggcccaattttcacggtccgactcggcatgcgacgagccttaatagtgagcaactccgagttagcaaaagagtgtttcaccaccaacgacagaatcttttccactcgccctagttcagtagctataaaattgatgggctacgattcagccatgtttggcttcgcaccatacgggccttactggcgggagatgcgcaagatagcagtaactgagcttctctctaataggcgcctcgagatacttaaaaatattaggatctccgagatcaacatgtctataaaagatttatatcaactctgggttgagaataagaacagtggtgttgatggcggcggtgacggtggtgaggtggtggtgggatcaccggttttggtggagatgaagaggtggtttgaagatgtgtcgttcaacgtggtggttaggatggtagctgggaaaagatatttcgggagaagggttgaaagtgatgatcgtgaagaggaggaggcgaggaggtggcagaaggcgatgaatgattttatgcatttggtggggattttcgtggtgtcggatgccattccatttttagggtttttggatttccaaggatatgagaaggagatgaagaagacggcggttgagattgattatgttatgggaagatgggttgaggagcaccaacggcggaagctggagagggtggcggggggatctgatgatcaacaggaagatttcatagatgtgatgttgtcgatcttaaaagatggtgatcagttctatggttatgatcctgatacggttattaagtcttcatgcctgtctcttgttttaggtggtagcgacacaatatcagtaacactaacatggacggtctccttactgctaaacaatcgcaatgtgttagaaaaagctcaaagtgagttggacatccacgtaggcaggggaagacaagtggacgaatcagatatcaacaatcttaaatatctccaagccatcgtcaaagaaaccatgcgtttatacccagctggaccactatcagcaccaagagaggctatggaagactgcaccatagctggattccatgtccctaaaggcacacagttgatgctcaatctatggaaattgcatcgagaccctcgcgtttggtcggatcctttggagttcaaaccggagaggtttcttactactggcacccatggagatgttgatgttaaaggacaacatttcgaattattaccgtttggagctggtaggcggatatgcccagggatatcttacgcccttcaagtcttgcatttgacccttgctcgtcttcttcatagttttcatttatcaacgccatatgatatccccgtcgatatgactgaatcttctggactttcttgcccaaaagcaactcccttggatgtcctccttacacctcgtctcccttcagagctttatgtgtcttaa

SEQ ID NO: 164 - DNA, 1686 bp, Chelidonium majus
atggatttgttcatcttcttcagccggttccaatatattgtaggattattagctttcctgaccttcttctattatctatggcgggtttcaattacaggaacaaggatcaaaaccaaccaaaacatcatgaacggcaccaatatgatggcaccggaagctgccggtgcgtggcccatagttggtcatcttcctcagctagtaggccctcagccactcttcaagattcttggagacatggccgacaagtacggttcgatattcatggttcggttcgggatgcacccaaccttggttgtgagcagttgggaaatggcaaaggagtgcttcactaccaatgacaagttccttgctagtcgtccaactagtgctggaggcaagtacctcacctacgactttgctatgtttggcttctcattttatggcccctattggcgtgagatccgtaagatctccacgctcgaactactatcccatcgtcgcgttgagttgctcaaacatgtcccttacactgagatcggcggctctatcaaacaactttacaaactttggatggaaacacaaaaccaaaataagcaacgggatgatcatcaggtaaaggtcgacatgagccaagtgttcggatatctaacattgaatacagtgttaaagctagtggtaggaaagggtctattcaacaacaatgacatgaatcatgaacaggaagaaggtcgaaagctccacgagacagtacttgaattcttcaaactggcaggggtctcagttgcatcggatgctcttccattccttggctggctggatgtagatggacagaagagaagcatgaagaggatagccaaagaaatggatttaatcgctgaaagatggcttcaagagcatcgacagaaaagactaacatcaaacaacaaggctagcagcggccatgacgacttcatgagcgtgttgctatccatccttgacgacgattccaatttcttcaattacaatcgtgatactgtcattaaagccacctctctgaacctgatattagcagcttcagacactacatcagtgtccctgacttgggttctctcgttattagtcaccaaccccggtgccttgaaaaaggtccaagatgaactggatactaaggtgggcaggaacagacatgtcgaagaacgagacatcgagaaactggtctacctccaagccacagtcaaggaaactctacggatgtacccagctggtccactatcagtaccccacgaagctacccaagactgcaccgttggtgggtatcaggtaacagcaggcacacgtttggtggtgaacgtgtggaaattgcaacgcgacccgcgtgtgtggccaaacccatctgagttcaagccggagagatttctaccagacgggtgtgaggttggttgtggtgaagcagcaaatatggatttcagaggacaacattttgaatacataccatttgggtcaggaagaaggatgtgtccagggatcgactttgccatacagatcatacacatgacactggcctgcctactccatgcattcgagttccaggtgccctcatcactagataaacatcttgtacctgcagtaatcgacatgagcgaaggttcaggactcaccatgcccaaagtaaccccacttgaagtcctccttaacccacgcctacctcttccgctttatgagttataa

SEQ ID NO: 165 - DNA, 1569 bp, Cissampelos mucronata
atggaggccatgggtgaatattttcagcttatttcatggactgtgttttcggctttgatcaccatctactttatattcagtaggaagactaatggaaaaaagaaggcaccggaaccaggtggtgcatggccgattattggtcacctccatctttttggagctcatgacctgttgtaccgaaagcttggggccatggccgacaaactcggcccagtattcatgatccgttttggcatgcatcgagccgtcgtcgtaagtaactatgaagtagcaaaagaatgcttcactgtcaacgataagatactcgcaagtcgcccacggattattgcttcaaaactcatgggctacaaccatgcggccgttggattaagcccttatggcccttattggcgagaggcacgtaagatagccaccttggaacttctgtctaaccatcgactccaactactcaagcacatcaggatatcagagattgatatgtggataaaagagctaaaagaattttgtatgaaaagcagtagcgatggtccagttcttgttcaattagatggatggttcaatgctttgacacttaatataatggttaggaatatagccggcaagcgatattgtggcggtgctgaagcctttgaagatgaagagtcgcagcgatggaagaaagtttctagagaacttatgttcttgttcggagtctttatggtacccgatgcatttcctgtactggaaggcatagatgtgcagggtttcgagcgagccatgaaaagggttggtaaggaaatggatttcttcttgagtcgatggttggaagagcatagaaggaagaaaatagaactctccgagaaaggaaacgaagttaatgatcaaggagctcaagatttcatagacgtgatgctgaacacaatcaaggatgccaagatctttgagcatgacgctgatacgatgatcaaagccacttgtatggctctagttgtagcagggaacgacacgacaatgatcactctatcatgggcagtttcattgttgctgaataatcgtggagttttagagaaagcccaggaggaattgagcaaccagataggaaaaaacaggcatgttgaggaaggagacatcgagagcttgccttaccttcacgcaattgtgaaagagaccttccggctataccctgctgcaccactttcattaccacatgaagctatggaagattgcaccattgccggctttcatgttcctgcaggaacacgcttgattactaatatttggaagctgcataaagatcctaatatttggcctgacccattggagttcaagccagagagattcctcactactcatgcccatgtcgattttaaaggtcaacacttcgaattcatccctttcggatcaggaagaaggatgtgccctggatcgtcgctagcaatcagtgttttgcacctcacccttgcacgtttgctccatgaattcgagcttaaaactccggatgatgcaccggtggacatgaccgaaggtccgggtatcacactcatgagagcaaacccccttcacgtgctcattaatccaagacatgactga

SEQ ID NO: 166 - DNA, 1605 bp, Cissampelos mucronata
atgtcctcgcccatccaacaactactcctctccttgacctccattaatggcggaaccatcatctcagccgtcataatatcactccttctcatcctcacccttcatcgcctcctaaaacccattaattccaacaaaaccaaacaccctccaagagcatccggggcatggcccgtcatgggccacctccacaagctccgcgggccggacctcccccaccgcaccctctcatccatggccgaccagtacggcccaatcttcacaatcaatctgggccccaccaccgccctcgtcatcagcgacccagccgtcgcaaaagagtgcttcaccaccaacgacctcaccttctcctctcgaccgaccactctcgccaccactctcatgtgctacaacaacaccatgttcgggttcgccccgtacggcccgtactggcgcgaagtccgcaaggtcgtcatggcccaactcttatcaacccgtaggctcgagtcactcaaaaacatttgggcctcggagattgaccgctgggttaagggcctggcccaaaaggcccaaagtgggtcgcatggtgtggttgaggtggagatgggtgattggctggcgaggttgactatgaacattgggctaaggttggtcgtggggaagagttgtggtgagatggggagtgaggagtcggagaggtgcttgggtgctatgcgggagtatccggagttgctgggtcggttcgcgttggaggacgcgttgccgtggttgggtcggtttgatttgcaagggcatcagagggagatgaggagggctgcgagggtcttggatgagattcttgatgggtggttggatgagcataagcgaaatagatcggggttaagtggtggtgatgatcatagggatcaggattttatggatgtgatgttgtctgttcttgaacaagatcaagattcgagtcttagcgaccatgatgctgatatgatcaacaagtccacttgcctgaatctaatcttaggcatggctgataccacaatggtggccttaacatgggccatttctcttctcctcaacaacaaaacgtccctcaagaaggcccaagaagaattacaagcccaagttggcaatgaaagacacgtggacgaatctgatgtcaagaacctagtctacctccaatccatcataaaagaagtgttgaggctttacccaccagagccactatcgggcccacgagaggcccttgaagactgcgaggtggcaggataccatgtcccgcgaggcactcggcttatcgcgaatttgtggaagatccatcgtgactcgtccacgtggcaggattctatggagtttcgaccggaaaggtttctgacggcccacgaacacgtggatgtgtggggccagcacttcgagttcatgcctttcgggtcgggtcgaaggtcgtgtccgggagtctcgtttgaggttcgggtgttgccattgatactggctcgtttgatacacgcattcgagatgacgacacgtggagatgtgccggtggatatgagtgaaagaccgggccttgttatctcaaaagcaagcccacttgaagttatgatttctccgcgcttgccccttcacttgtttgaataa

SEQ ID NO: 167 - DNA, 1611 bp, Cissampelos mucronata
atggagtttcatttgcttctccaagcagttgcagcaactctagtgaccttcttcctttatgagctatgggctctaaggaagaagttcagcaggcttaccaaaactccctcatcaaaggctttgctcaaagcaaagtgcgcaccagagccgcccggtgcgtggccgatcatcggtcaccttcctttgctggtttcagccaagcagcctcatcgggcatttgctgcacttgctgagaagtatggtccagctttcatgctccgcatgggcatgagtcctatgctgattgtgagtaccaaagaggttgccaaagaatgttacaccgccaatgatcatgtgtttgctactaggcctgtcaccaccgctgggaagctcatggcttatgatcactcggtcatgggcttcactccttttggaacctactggagagaaatacgaaagatcgcgacggtggagctgttctcggctcgcaggatcgggatgttgaagccggtaagacagtctgaggtctcgttgtggatgaagggattgcatgagaagtgggtgcataatggaaatagctcggtctccgtggagctgaagagtcaactggaagaactcactttcaatttgcttacacaaatggttgccggaaagcgttactacggaagtaacgttgcaaaggtggatgagaagatggcggggctatttcgccacgccgtccaacaattcaattatcaccttgggaactcggagatgtatgatgccttgccattcatggcatggttggacttcaagggcgacgccaaggccatgaaaaagacacaaaaggacttggattttattatgcagacttggttggacgagcaccgcctaaaagcggatcaaatgcgcggggacgccatcaacaacaccagagacttcctcgacgtgctggtgatgatggagaagaccggccaattttcatcggcaattaaagacagagacactacaattaaggccttggctctgacccaactagtagccggagtggacagcatggccaacacaatggtgtgggtgttggctctcctaatgaacaacccagaaatgctagccaaagcacaagacgagctcgacaacaacgttggcaaagacagactcgtggaggagtcagatatccctaatttgaagtacttacaagccctcctaaaggagaccctccgaatgtaccccgtggggcctttgttggtgccgcacgaggcaacggaggattgccacgtggccgggtattttgttccacgtggaactggcctgttcatcaacgcttggaccatacaacgtgacccaaatgtatgggctgagccgaactgttttaatccagagaggttcttaaccactcatgcagagatggacgtgaagggtcaaaatcatgagctgttgccattcgggtcgggtaggcgatcgtgcccaggtgtgggactggccctccaagtgatgcacctcaccttggctcgaatattacaagcgtttgagttgaagactcaatcgggtgttggaattgacttggaagagtgctccggcatactgctttccatgatgcacccattgcaagtgatgatggcacctcgccttccttccgaactctatgattga

SEQ ID NO: 168 - DNA, 1575 bp, Eschscholzia californica
atggattccttaatccttaccaattggtttccaatatcaattgcttctgttttaaccctagttttcctttacaaagtcttactttcctcaagaactcttaaagataagaagattaagacttcacccatggcaaatggtgcatggccaattcttggtcatctccatctctttggttcaggtgaattacctcataaaatgctagctaccatggctgacaagtatggctcagccttcaggatgaagttcggtaaacacacaacactagttgtgagtgatacccgtatcgttaaagaatgtttcactaccaacgataccctcttctctaaccgtccttccactaaagcttttcaactcatgacttacgataatgagtcggttgcctttacaccttacggtccttactggcgtgagcttagaaagatatccactcttaaacttctatccaaccatcgtctccaagccatcaaggacgttagagcctcggaggtaaacgtatgcttcaaaagcttatacgatcagtgtaaaaatccaagtggagctcctattttgattgatatgaagaaatggttcgaagaggtgtcgaacaacgtggtgatgagggtaattgtggggagacaaaactttgggtctaagattgtgcaaggtgaggaggaagctatccattacaagaaggtcatggatgagctcttacgtctcgctagcttgtctatgttctcggattttgctcctttacttggtttcttggacatctttcaagggaacttgagtgccatgaaacaaaacgccaagaaggtagacgcaatccttgagaactggttggaagagcatcggaagaagaagaactcagttgctgaaagcgagcaagatttcatggatgttatgttgtcaattgccaacgagagcaagttgtctggtcacgatgccgatactgtcattaaagctacttgcctagcaatgattatgggtggaacagacactactgctgtaagtctaacatggatcatttctttattaatgaacaatcgccatgctttgaagaaagctcgagaagaattagatgcactagtaggaaaggacagacaagttgaagattcagatttaaagaatttagtatacatgaatgctatcgttaaggaaacgatgagaatgtacccgttaggtactcttctcgaacgcgatactaaggaggactgtgagatcggcgggttccatgtcaaaggtgggacgaggttgctagtgaatgtgtggaagttgcaacgagacccaaatgtatgggttgatccaacagaatttagacctgaaagatttctaaccgagaatgcggatatagatgttggaggtcagcattttgagttgctaccatttggagcaggacgaagggtgtgtcctggggtgtcgtttgcactacaatttatgcatttagtacttgctcgtctcatccatggatacgatttgaatactctaaacgaagaaaatgtggatctgacggagagcccagaaggacatgtgaaccacaaagcatcgcctcttgatctcatcctcacccctcgtctacattacaagttgtacgaatag

SEQ ID NO: 169 - DNA, 1599 bp, Eschscholzia californica
atggatactgcttcatcaatttcccttctcctcccttgggcagtagtagttccctccatagctacccttcttgctttgctacttttcctcttcatcacttcaccaaaaacacccaagaggaaaacaagttcaaaaccaccacccactgttcttccaggtgcctggccaattctaggtcatctccatctctttaaagaaggagaatcacctcaccacatgcttaagaacttagctgataaatatggacctgctttcgtcatgaaattcggacaacatcgttccctagttgtaagcaacactaaaattgttaaagaatgttttactactaatgacaccctcttttccaaccgtccatctactactgcctttgatctcatgacttatgctcatgactcggtagctttcacaccttatagtccttactggcgcgagctaagaaagatatcgaccctcaaacttctatctaacaaccgtctcaaagcaattaagaagctccgaggagaggaagtggacgtttgttttcgtgggttgtacggtttatggaagaataaaactaaaaatggtgctccagtcttggttgacatgaaaaaatggtttgaagaggttgcaaataatgtggtgattagagtgattgtggggaaacttagttttgggaccaagattgttgatggtgaagaagaagccgttgaatataaaacagtcatggatgaactcttacgtcttgctagtttgtctttgttatccgatatggctcctatactcggttggttggatttcttccaaggaagtgttcgtaaaatgaaacaaaccggtaaaagactagacgttttacttgagaaatggttgggggagcaccgagagaagaagaacttggttggggaagatgagcaagatttcatggatgtcatgttgtcgatcgtggaagaaagtaagctatctggccatgaagctgatgccgtaattaaagctacatgcttggccatgattatgggtggaacagacacaacagcagtaactctgacatggatcatctccttattgatgaacaatcgtcacgcactagaaaaagctagagaagagttggagacgcacgtcggaaaagatagacaagtggaagatacggatttgcagaacttggtctacttgagtgctattgttaaggaaacaatgcgattgtaccctttgggtactcttctcgaacgagaaactaaagaagactgcgaggttggagggttccacatccaaggtggaacgcgtttattggtgaatatatggatggtacaacgagaccccaccgtatggaatgacccgtcggcatttaaaccagagaggttcttaacagataaatcggaaatagatgttgggggtcaacatttcgaactgataccatttggggctggtagaagagtgtgtcctgccgtgtcgtttgctcttcaattcttgcatttggttctcgctcgactcatccatggatatgacttgggcactccaagcaacgtggaagtagacttgactgagagcctggaaggacacgttaatcataaagcatctcccctcgaactcctcctcactccacgcctcaacccgaagctttattaa

SEQ ID NO: 170 - DNA, 1647 bp, Eschscholzia californica
atggaatctgagatccaatatcaaactgcaacaatggcttccattcttagtactaatttgattctaagcagtatttttactgcttttcttctctatttcttactaaagatgagtccatttaggtcatcaaaaaacaagtcaagaaagcaagcaccaaaaccaactggttcatggcccattataggtcatctccttcatctccaaggaccaaaccttcctcacataaacttagcagctttggctgataagtatggatcagtgttcagcttccgtattggtctccgtccagccctcgttgtcagttcttgggagatagctaaagagtgtctaactacaaatgatagagtcttcgtctctcgcccgccgttaatagctatgaaacacatgggttatgaccacgccttgttcggattctccccttatggtccatactggcgcgaactccgtaaactagtgaaccaagaacttctttcgaacactaggattgagttgataaaacatgtttgggatactgaaataaatacattcattaatgacctttatgaagtttgggctatgaaaagtaatgaaggtgggggtgatgttgtggttgaaatgaagcaatgcttgtacgattttactctcaatctcacactaaaaatacttaccggaaaacggtatttcggtggtggtggcagcgaagagttaagagaagaagcaggaagatgtcaaaaagcagtaagaaactttcttaggttagtgggtacttttacagctcaagatgtcattccatttttggaaggttggttagacttgggtggtcatgagaaggagatgaaaattacaggaaaagaactcgactccctacttcaaaaatggttagaagaacataaagtaaagaaatcgtcagctggggaagaaggccaggagaatcgaggtggtgatgaagaagatttcatgggggtgatgcttacaaaacttcgtgatcacgagaagcttttaagttattacgatgctgatactatcaacaaggctacttgcttgactgtaatcctaggtgggagcgacaccacgatgatgactctagtatgggctctcgctttactagtaaatcatccgcatgtaatgaagaagctccaagatgagttggatacccacgtaagtaaagaaagacaggtggaagaatcagatatcaagaacctcgcgtatcttcagtctgttatgaaggaaacaatgcgtcgttacccagggacccctctatatgttagagaatcgatcgaggattgcactatagctgggtacgacgtcccaacaggaacccgtcttgtagtgaatgcgtggaagatccaacatgacccacaagtatggtctaacccattcgagttcaatccagagagattccttacaacccacaaggacatagatgttagaggtcagaatttcgaacttatcccatttggagcaggcaggagaatgtgccccggggcttcactcggtcttcaagtggtgcacctgactctggctcgtctagtacatggatttgagtttaaaacaccagatggcgaacccatggatatgacggagagtataggactaactaatcttaaagccactccacttgaaattatgctcactccgcgcctctcttccaaactatatgtgtgttga

SEQ ID NO: 171 - DNA, 1665 bp, Eschscholzia californica
atgggtctttcatttgatctttcttctcataactttcttcaattctcgaaccccactattctcattggcctctttggtttactagtttaccttttactagtaaatcttcgaaaacgaatatcacgaaaaaatgaggcacccgaagtggagggtgggtggcctatcataggtcatcttcatcatttcatgggtgggaaaaacaagctactccatgtagcatttggagcttgggctgataagtatggaccagtctatactctgaggatgggtctgaataaagtactagttgtgaatagtgcagaagtagcaaaagagtgttcaaccactaatgacatgctttttatggctcgtccatatcgaatagcctctgagatcatgggttatggatatgcgatgtttcctatcgctccttatggaccattctatctcaaaatgcgaaaaatggtcacccaagagcttctctcaaatagtagggttgattctctaaaacatgtgtggggttctgagataaaaaatgccattcaagaacttcacaagaaagtattatcaactaaaggtggtggtccaatttcaatggacatgaagggatgggtttccaatttaacgttccgaacggctatgaaggtgatttgtggtggtgttggtgttgatggtggtggtggtggtggtggtgctacttctcctgcaactagtattggagaacataattatgatgaagttggaagttttcaaaaagcattgaaagaattctttgttttactaggagaaattaggatttctgatgtgataccattcctagggtggttagatatgcgaacagggtacgtggaaaagatgaaggacaatggaaaatttctagacaatttaatggaggaaatgttggaagaacacaaaaggaagagaaggtcactaactgaagaagaggaaaaagatggaggttatgtggagcaagatttcatggacgtaatgatatcgaaacttaatgatccaaagcttctgtcctattatgacgctgatactatcaacaagtctacttgcctgactctaattttaagtgggagtgagacaacgatggttagtatagtttgggccttagcgttactagtcagtcatccacacgtgttaaagaaagcgcaagatgagttggatacgcttgttggtcgggaaagacaggtagacgaatctgatatcaaagatttggtatacctccaagctgtagttaaggaagcattgagactatttccaccggctccactttcaactccacgcgttgcaacagaggattgtgtcgtatcaggatatcatgtacctgcagggacccaactttttgtaaatacttggaagattcaacgtaacccggaagtatggcctgaaccatcagagtttagacctgagagatttttcacaacccacaaggatttcgacgttagaggtctacattatgacctccaccctttcgggtctggtagaagagcatgtccaggtgctggcttcgcccttcaagtggtgcatctaaccctagcttctctattacatgggttcgagattaaaaacccatcggatgaacccattgatatgactgagagtccaggagtaactaacttgaaagcaaccccactgaaagtcctcctgacccctcgcctcttctctaaagaagtttattaa

SEQ ID NO: 172 - DNA, 1686 bp, Eschscholzia californica
atggagaagcccatcctcctccagctccaacctggtattttaggcttattagctttgatgtgcttcttatattatgtaataaaggtttcattatctacaaggaactgtaaccagttggtgaggcatccgccggaagctgcaggttcatggcctatagttggtcatcttcctcaactagtaggctctggtaagcctctgtttagagttctcggagacatggctgacaagtttggaccaattttcatggtgcgatttggagtacacccaaccttggttgtgagcagttgggagatggcaaaggaatgcttcacctccaacgacaagttcctggctagtcgcccacctagtgctgctagcatttacatggcatacgaccacgctatgcttggcttctcctcttatggcccatattggcgtgagattcgtaaaatatcaaccctccacctactctcccatcggcgccttgagttgcttaagcacgtccctcacttagagatccacaattttatcaagggattgtacggaatttggaaagatcatcaaaaacagcagcagcagcctactgcgagagatgatcaagattcggttatgctggagatgagccaattatttgggtacttgaccttgaacatcgtattgagcttagttgtaggaaagagggtttgcaactaccacgctgatggtcatcttgatgatggggaagaagctggccaaggtcaaaagctccatcagacgataactgatttctttaaactgtcaggggtttcagtggcttcggatgctcttccgttcttaggcttgtttgatttggatggacaaaaaaagatcatgaagcgggtagccaaggagatggactttgttgcagaaagatggcttcaagataagaaatcgagtttgttgctgtctagcaaaagcaacaacaaacagaatgaggcaggggaaggcgatgtggacgatttcatggacgtattaatgtccacactcccagatgatgacgattcctttttcacgaagtatagtcgagatactgttattaaagccaactccctctctatggtcgtagcaggctcagacacgacatctgtttctttgacatgggctctttccttattactcaacaacatacaagtcctaagaaaggctcaagatgagctggacacgaaagtcggtagggacaggcatgtagaagagaaagacatcgataacttggtctatcttcaagctatcgtcaaggaaacactccgcatgtaccctgccggtccactttcagtaccacacgaagccattgaagactgtaatgttggcggataccacataaaaacaggaacccgtctgctggtgaacatatggaagttgcagcgcgacccacgagtgtggtcaaatccatctgagttcaggccagagagatttcttgacaaccaaagtaatggaacactgctggatttcaggggtcaacattttgagtacataccatttgggtctgggcggaggatgtgcccaggcgtgaaccttgcaaccccgattcttcatatgacactagcacgcttactacaatcattcgacttgaccacaccctcgtcatccccagtagacatgactgaaggttcaggattgacaatgcccaaagtaactccacttaaagtactactcaccccacgcctccctcttccactttatgattattag

SEQ ID NO: 173 - DNA, 1698 bp, Eschscholzia californica
atgaatttgtctagcaaattgatgggttcatttgatcttttctctcttaactttctccagttctcaaaacccgccagtatggttattattggcatttgtagttttctagtttacttttcactactaaatcttgtaaggcgagtactagcaccgtcttgtacgatgaaaaacggaaaaactgagccaccggaggtggaaaacgggtggcctattataggtcatcttcaccatttcatgggtaaaaagaataagctaatccatgaaatatttggagacatggctgataagtatggaccgacctttactttaaggatgggtctgactaaagttctagtagtgagtagtgccgaagtagcgaaagagtgtttaactacaaacgatttggtattcattggtcgtccacctcgtgtagccaattcactccttggttatagttttgccatgtttcctttttcgccttatggcacatactatagccaaatgcgaaaaatagtcacccatgagcttctctcaactagtagggttgagtctctaaaacatgtgtggaattctgagataaacaaagccattcaagaacttcatcacaaagtagtatcagttggaggtggtagtcctgttttaatagaatttaagcgttggttttcggatttaacgttaagaactactgttaagttgatctgtgggaagcagtactttggtacggatggtgctactcaggcgagtatgactattaatggaggaggagatgatgatgaagctgggaagtttcaagaggccttgagagagttcttttgtttactaggaaaatttagggtttctgatgtgataccatttttagggtggttagattttggaacaggttataaggaaaagaaaaatagaatgttcattgatagtttaatggaggaatggttggaagaacacaaaatgaagagaagattactaaatgaagcagataaaaaagaaagtcgtatagagcaagatttcatggatgtaatgatctcgaaacttgatgatcctaaccttctatcccattacgatgctgatactatcaacaaggctacttgcttgactttgattttagggggaagtgacacaacaatggttagtttggtttgggccttaacattgttaatgaatcatccacatgtgttgaaaaaggtccaagatgagcttgatttccacgtaggtcgtgagagacaggtcgaagaatctgatatgaaaaacttagtatatctccacgctgtaatgaaagaggcaatgagactaaatccagcaggtacgttatcggctccacgtatgtcaacaaaggactgcaccgtatccgggtaccacattcctgcaggaacccatctattcatgaatacttggaagattcaacgcgaccctaatgcatgggttgaaccaacagagttcagaccagagagatttctcactacccataaggatttcgatcttagagggcagaactttgaactcctccctttcgggtcgggtagaagatcatgtcttggtgctaactttgctcttcaagtgttgcgccagactctagctcgcttgttacatggattcgatctcaaaactccatcagatgagcccgtcgatatgactgggtctgctggactaattaatatgaaagccactccactcgaagttctagtcaccccacgcctcttctctagtgaattatatgggtaa

SEQ ID NO: 174 - DNA, 1853 bp, Eschscholzia californica
atgctcataaaacctctcgggagcaagataacatctcctcctccctccagtgtcaaagaaaaaagagaaatccgaagggtcgtcatgaggtatataagtgggcttaaacgatgcaaaatcagcaagataaagccaattccaagatgtaaccaaaacattctcgcatttaatatcaccatgacaaacaccaagtatcttccaatgaatttgctcatcttcttccaattcctcctccaattccaagttcttgtaggattatcagttttgctagccttctcctattacctatgggtttcaaaaaatcccaaaatcaacaaatttaagggtaagggtgccttattagcaccccaagctgccggggcatggcctattgttggtcatctccctcaactagtaggccccaagccgctcttcagaattcttggagccatggctgacaactatggacctatcttcatgctccgattcggggttcatccaactgtcgtcgtgagcagttgggagatgacaaaggaatgtttcactaccaacgataggcaccttgctagtcgtccatctaatgctgcttcccagtaccttatctacgaagtctatgctttgttcggcttctccttatatggtagctcatattggcgtgatgctcgtaagattgctacgctcgaactactctcccatcgtaggcttgagttgctcaagcatgtaccttatacggagatagatacatgtatcaaacaattgcacagactttggacaaaaaataacaaaaaccaaaacaaccctgagcttaaagtcgaaatgaaccaattttttactgatctaaccatgaatgtgatattgaagttggttgtaggaaagcggtttttcaacgttgacgatgcagcggatcatgaaaaagaagaagctcgaaaaatccaggggacaatatttgagttttttaaacttacggagggttcagtttcagcaggtgctcttccattactaaattggctggatctaaatggacagaagagagccatgaagagaacagccaagaagatggactccatagctgaaaaattgcttgacgagcaccgacaaaaaaggctatcaaaggaaggtgtgaaaggcactcatgatcataatgacttcatggacgtattattgtccattcttgatgctgatcaaggagattattcccatcatccattcaactacagtcgcgaccatgtcataaaagccaccactctgtcaatgatcctctcttccatgagcatatctgttagtctttcatgggcactctctttattactcaacaaccgccatgtcttaaaaaaggcgcaagatgagttagacatgaacgttggcaaggacagacaagttgaagagggagacatcaagaacctggtctatctccaagccattgtcaaggaaacattccgtatgtatcctgcaaatccacttcttctaccccatgaagctattgaagactgcaaaattggtgggtttaacgtaccagcaggcacacgtgtggtagtcaacgcatggaaactacaacacgacccacgcgtgtggtcgaacccatccgagtttaagccagagaggtttctcaatgaccaagcagcaaaggtagtagatgtgagaggtcaaaattttgagtacttaccatttgggtctggacgaagagtgtgtccaggaatctccttctccctccaaaccattcacatgtcactagctcgcctagttcaggcattcgagctaggaacgccctcgaatgagcgcatcgatatgactgagggttccggcttaaccatgcccaaaacaaccccgcttcatgtccttcttaacccacgtcttcctcttccactctatgaatg

SEQ ID NO: 175 - DNA, 1599 bp, Eschscholzia californica
atggagtttcattttcctctcatggaacaattccaaccatttttcatttttgcccttcttctagcctccttcatttttctctacaaactcttcaattttggaaacagaatcactaaaaatgggaaaccaacagctccggaagcatcaggaggaagactaattatgggtcatcttcatctattcaatggaactgagttaactcaccggacactcggttctatggctgataaatacggtccagctttcaatatccgattcggttcacataaaacacttgtagtgagtagttggaaaattattaaagaatgttttactacaaatgaccgattcttttcgaatcggcctggttctttagcaatcaaactcatgttttatgatgccgattcagttgggtatgcaccatatggatcgtactggagagaacttagaaaaatttcaaccttaaaactcctttcgaaccatcgtttagaaaccctaaaacatttgagaacttctgaagttgattcttgttttaatcaactaatgaattcttgggctgaaaacaaaaacaggggagactctgattttgctccggtgaggatggatgattggtttggggatttgacgtttaatgttgtagcaagaattgttgccggaaagaagaatttcgccggaggagcagcgagaggtgatgccggagctcagagatataaatcagccatggatgaagcttttagactgatgacaatatttgcttattcagatgtgattccatctcttgggtggttagataaattgagaggactagttggagatatgaaaagatgtgggtctgaaattgattcagtagttgagagttgggtggatgaacatagattgaaaagaagggtttctaagaaaggaggtgaattagatcttgaacaggatttcattgatgtttgtttggatatcatggaacattcttctttgcctggtgatgatcctgaaattgtcatcaaatctacttgcttggacatgatattgggtggaagtgacacaacaacagtaaccctgacatgggccctatccttgcttttgaaccatccccaagtcctgaaaagagccaaggaagaattagatagtcaagttggaaaggaaagacaagtagaagactctgacattcccaaccttcctctcatccaagctatcatcaaagaaacaatgagactgtatccagccggcccattgatcgaacgacgaactatggaagattgcgaggttgctgggttccacgtaccggctggcacacgtctattagtgaatctatggaagatgcagagagacaaggaagtgtggagtgaagaacctttagagtttagaccagagagattcctaacgagcaacacagaagttgatctcaaaggacaacattatgaactgataccatttggagcaggaagaaggatatgccctggtgtgtcctttgcggtgcagttgatgcatttggtgctcgcacgtcttcttcatgggttcgaaatgacaacaccaatgggtgagaaggttgatatgacagagagtgcaggattaattagtcacaaaatcacaccacttgaagttcttatcaaaccactcagggtctaa

SEQ ID NO: 176 - DNA, 1533 bp, Eschscholzia californica
atggattccttcttgcttgcttattgggttccaatttcagttgcttctattattgcttttgttttcctctacaatctcttttcttcaagaactcttcaaaataagaagattaggacagcacccatggcaacgggtgcttggccgattctcggtcatctccatctctttggttctggtgaattgcctcataaaatgctagctgccatggctgacaagtatggctcagccttcaggatgaagtttggtaaacacacaacactagttgtgagtgatacccgtatcgttaaagaatgtttcactaccaacgataccctcttctctaaccgtccttccactaaagcttttcaactcatgacttacgataatgagtcggttgcctttacaccttacggtycttactggcgtgagattagaaagatatccactcttaaacttctatccaaccatcgtctccaagccatcaaggacgtaagagcctcggaggtaaacgtctgcttcaaaaccttatacgaccagtgtaagaatccaagtggatcagctcctattttgatcgatatgaagaaatggttcgaagaggtgtcgaacaacgtggtgatgagggtaattgtggggagacaaaactttgggtctaagattgtgcaaggtgaggaggaagctatccattacaagaaggtcatggatgagctcttacgtctcgctagcttgtctatgttctcggattttgctcctttacttggtttcgtggacatctttcaaggaaacttgagtgccatgaaacgaaacgccaagaaggtagatgcaatcctggagaactggttggaagagcatcgcaagaagaagaactcagttgctgaaagccagcaagatttcatggatgttatgttgtcgattgttgaggagagcaagttgtctggtcacgatgctgatgccgtaattaaagctacttgtctagccatgatcatgggcggaacagataccacagcagtgagtctaacatggatcatttctttattaatgaataatcgtcacgctttgaagaaagctcgagaagagttagatgcactagtaggaaaggacagacaagttgaagattcggatttgaagaatttagtttacatgaatgctattgttaaggaaacaatgagaatgtacccattaggtactcttctcgaacgtgagactaaggaggattgtgagatcgacgggtttcatgtcaaaggtgggactaggttgctagtgaatgtgtggaagttgcaacgagacccaaatgtatgggttgatccaacagaatttagacccgaaagatttctaacggagaatgcagatatagatgttggaggtcagcattttgagttgctaccatttggagcaggacgaagggtgtgccctggggtgtcgtttgcactacaacttcatgcatttagtacttgctcgcctcatccatggatacgatttgaatactctaaacgaagaaaatgtggatctgacggagagcccagaaggacatgtgaaccacaaagcatcgcctcttga

SEQ ID NO: 177 - DNA, 1605 bp, Glaucium flavum
atggagtttctctctctacaacttcaaccagtttccatttttgctcttcttgttgcctccattttcctctacaatttcttaattcacggaaaaaaatccaacaacaagaagaccacaaaaccaccagcaccagaagcatcaggtggatggccaattatgggtcatctccatctcttcaatgaaaacgagttaactcaccgaacactcggttccatggctgacaaatacggtccagctttcaacatccgattcggttctcatcctacactcgttgttagcagttgggacatcgttaaagaatgtttcacaacaaacgaccgattcttctcgaatcggcctggttcgttagcgattaaactcatgttctacgatgccgattcagtcggttatgctccctatggtgcttattggagagacttgagaaaaatttcaactctgaagcttctttcgaatcatcgattggaaaccctaaaacatttgagaacttctgaagttgaatcctgttttaaagaactttataatcagtggaggaacaacaaaactggtggtggtggagatggttttgctccggtgaggatggataattggtttggtgatttgacgtttaatgttgtggcgagaattgttgccggaaaaaagaattttgccggtggtgcggcgagtggtgatgccggagctcagagatataaggaagctatggatgaagcgtttaggttgatgacgatttttgcgttttctgatgtggttcccgcgttggggtggttggataaattgagaggtttagttggaggaatgaagcgttgtggggcggaaattgattctatagttgcggggtgggttgatgaacatcggttgaagagaagctctggcaagggaagtgatgctgatcttgaacaggattttattgatgtttgtttggagattatggaacattccacattgcctggtgatgatcctgaagttgtcatcaagtctacttgcctggacatgattttgggtgggagtgacaccacaacagtgaccctaacatgggccctttccttactattgaacaatccccatgtgttgaaaagggctagggaggaattggatacaaatgttggaaaggatagacaagtagacgactcagatatccctaatcttgtatacatccaagcgatcatcaaagagactatgagattatacccagctggaccactgatcgagcggaggacatcagaggattgtgaggtaggtgggttccatgtaccagctggtacacgcttattggtaaacttatggaagatgcaaagggacgggagtgtgtataaggaggatcctttggagtttagcccggagagattcctgactagcaacgcagatgtagatttaaagggacagaattatgaattgataccatttggggcaggtaggaggatatgtccaggtgtgtcatttgcagtccaattgatgcatttggtgctggctcgcctcattcatggcttcgaaatgaagacgcctgaaggtggaaaggttgacatgacagaaagtgcaggactaattagtcacaaggtgacgcctttggaagttctgctcaaaccacgtctagcaatccaacattcatag

SEQ ID NO: 178 - DNA, 1686 bp, Glaucium flavum
atgcatgcgaaactgaccttgattaagaaaatggagttcaccatcatcaactctctagaaatccaaccaataatctccactttcgctcttcttactttctccattcttctctacaaaattctcttgaaccatggaagagaaaacaagaacaataaaccaaaaacatcatcatcatcatcatcaataccagaagtagcaggtgcatggccgataatgggtcatctccatctcttcaacggagacgagttaatgcaccataaactcggttccatggccgaaaaatatggtcaagctttctatatccgatttggttctcataaagcggttgtggttagcaattgggagatggttaaaacatgtttcactacaaataaccaaatcttcttaaataggcctcccatgttagctattaacctcttgtttttccccaccgattcgcttagttacataccgtatggtgaccactggagagagttgagaaaattttcaaaccaaaaacttctttccaatcaccgcatcgaaacccagaaaaatttgagaaaattagaagttgattactgttttaaacagctttgtaatcagtcttctaagtattttataattaacaacatggacgaccaagacagcaagtttgctctagtgaggatggatacttggtttgatgatgtgacattgaatgttctggcaagaattattgccgggaaaaagaagtttatatccggcggagcaacgagtagtggtgatgatgataatgctgaagctcggagatacatggaagctttagatgaaggacttcgtctgatgacgagtttcactttctccgatgtgcttccgtggttggggtggttggataatttgagaggtttggctggaaagatgaagcgttgtggtgcagaacttgattcggtttttgcggggtgggttgaagaacatcgtgtgaagagaggctctagaaaggatggtgatgatgctgatcttgaacaggattttattgatctttgctgggagagtttggaacaggtgcctggaaatgatcctgcaaaaatcatcaagttaatttgcatggaaatgattttgaacgggagtggcgccacggcagtgaccctaacatggaccgtctctttactattgaacaaccccgacgtgttaaaaagggcaagggaggagttggatacacacgtcggaagtcatcgacaagtggacgaatcagacatccctaatcttgtttacatccaagcaatcatcaaagagggaatgagattgtatccacctggaccattccttgagcgaagtacaactgaagattttgagatagatggggttcatgtaccagctgggactcggttatgggtgaacttatggaagatgcaccgagacgagagcatgtatcaggaaccactcgagtttaaaccagagaggttcttgaatagcaattcagatgtagatctaaagggacagagttaccaattgctaccatttggggcaggtaggaggatatgtcctggcgtgtcgtttgcgttgccgttgatgcatctgacattggctcgtctcattcatggcttcgaaatgaagttgcccgtaggtgttgaaaaggttgacatgacagaaaatggaggtataattaaccggaaggcgacacatttggatgtgctgctcaaaccgcgcctcatcgctcaacaagcttaa

SEQ ID NO: 179 - DNA, 1611 bp, Glaucium flavum
atggatacactttcaattcaatggattgtaccttccatagccacccttcttgccttagttttcctctacaatctcatttttacttccaaaaaaactaccaagactaacaacactaggaaggcaccaatggcatccggcgcatggccggttcttggccacctccatttatttggaaccggtgagctacctcacaaaatgcttgcaacaatggctgaaaactacggtaccgccttcacaatgaagttcggtaaccacactacactagtcgttagcgacactcgcatcgtaaaagaatgtttcactaccaacgacacccttttcgcgaaccgtccgtccaccaaagcattcgatctcatgacttatgccaatgactccgtagccttcacaccttatagcccgtattggcgtgagcttcgaaagatatcgactcttaaacttctctcgaaccatcgtctccaatcgattaaagacgttcgcgtcgcggaggtgaacgtatgttttagaggcttacacgttctatgcaagagtaaaatctatggagctccggttttagttgacatgaaaaaatggtttgaagaggtctcgaacaatatagtcatgagagtgatcgtggggaaacaaaattttgggtctaggattgtgcaaggacaagaggaggctgtctattacaagagtgtcatggacgagcttttacgtctagctagtgtatccgttttatcggattttgcaccgttatttggttggttggatttctttcaaggaaacataagtgctatgaaacgaaatgggaagaaactagatgtgatacttgagagatggatggaggagcatagacaaaagaagataagctcatcgtcgtcgatagccgcgtccggcgccggtgaagatgatgagcaagactttatggatgttatgttgtctatcattgaggagactaagttgtccggtcgcgacgccgataccgttattaaagctacttgcttggccatgatcatgggagggactgacactacagcggtaagcctaacatggatagtctccttattgatgaacaatcgacatgtactgaaaaaggctcgagaagaattggactcactagttggaaaggatagacaagtagaagattcagatttgaagaattttgtatacatgaatgctattgtcaaggaaacgatgcgattgtatccgtttggtgctttgctcgaacgcgacaccaaggaggactgtgaggttggtgggttccatgtcgaagccggcacccgtttactagtaaacgtatggaagttacaacgagaccctaatgtatggaaagatccattagagtttcgaccagaaagatttctggtcgagaacgtcgatatcgacgtcggcggtcaacatttcgaactattgccgttcggggccggtagaagggtgtgccccggcgtgtcgttcgcacttcagttcatgcatttggtactagctcgtctcatacatggatatgaattggaaacactaaatggtgaagatgtggatttaactgagagcacagaaggacatgttaaccataaagcatcccctcttgatctcctcatcacccctcgcctcgactctaaggtctacaattactag

SEQ ID NO: 180 - DNA, 1599 bp, Glaucium flavum
atggatagtacccttgttctccaatgttttgtaggttccatggcagctgtttctgccttggttttcctatacaatctcatatttagctcatcgaaaactaccaagggtaaggttcttaggaaggcacctatggcagccggggcatggccaattcttggtcacctccatttgtttgggtcaggtgagctgcctcacaaaatgttatccaagatggctgagaagtatggccctgcgtttacattgaagttcggtaagcacacgacactagttgtgagtgacacccgcgtcgtaaaagagtgtttcactaccaatgatacacttttcgctaaccggccttcgactaccgcatttgatctcatgacttatgccaatgactctgtagccttcacaccttatagtccttattggcgtgagcttagaaagatatctactctcaagcttctctctaaccaccgtctccaatcgattaaggaaatccgtgtctcggaggtgaacgtatgttttagggagctatttgagatgagcaagagcaaaaccgatggagctgctccggctttggtggatatgaagaaatggttcgaagaggtgtcgaacaatatagtcatgagggtaatcgttggaagacaaaattttgggtctaagattgtgcaaggtgatgcggaggctgtcaactacaagaatgtcatggatgagctcctacgtctcgctagtttgtctatgttatcggatttcgctcctttacttggttgggtggatatgttccaaggaaacaagaacgcaatgaaacgaaatgccaagaaagttgacaccatactagaaggctggttggaggagcataggaagaagaacaagaagatgagctcatcagaaaatgatgaacaagacttcatggatgttatgctttcgattattgaagagaccaagttatctggccgtgacgctgataccgttattaaagctactgtcttggccatgataatgggtggaacagacaccacggcggttagtctaacatggattgtctccttattgatgaacaatcgtcatgtattgaagaaggctagagaggaaatagacgccattgttgggaaggatagacaagtagaagattcagatttgaagaactttgtatacatgaacgctatcgtcaaggaaacgatgcgattgtatccacttggtgctatgctcgaacgcgacaccaaggaggactgtgaggttggtgggttccaagtacaagccggcacacgattactagtaaacgtatggaagttacaacgagacccaaatgtttggagtgatccatcagagtttagaccagagagatttttatcggagaacgctgatatagacgtcggcggtcaacatttcgaattactaccatttggtgcaggtagaagggtgtgtcccagggtgtcgttcgcgctccaattcatgcatttggtactggctcgtcttatccatggatatgaattgggaactcaaaatgatgagcttgtggacttaactgagagcacagaaggtcatgttaaccatatggcttcccctctagatctcatcctcaccccacgcctcagcaaccctaagctctatgattattag

SEQ ID NO: 181 - DNA, 1557 bp, Glaucium flavum
atgttctttacttcatcttcaaaaaccacaaacaaaaacacaagtaagaaaccacccatggctcccggtgcatggccaatactaggtcatcttcatttgtttaaagaaggtgagttacctcaccacatgcttaaatccatggctgataaatacggccccgccttcctcatgaagttcggccaacaccggtccctcgtcgtcagcgactaccgcattgttaaagaatgtttcactaccaatgacaccttattttccaatagaccgtctacaactgcctttgctgtcatgacttacgctacggactccgtcgcgttcaccgaatatagtccttattggcgtgagcttcgaaagatatccactcttaagctactctcgaacaaccgtctccaggcgataaaaaaactccgagaaagcgaagtgaacgtctgtttccgaggtttatatgattcgtggaggaagaataagagtgaacagaatggtgctggtaatagtattgatggtggtaacgaacgagcacgtccggttctcgtcgacatgaaaaaatggttcgaagaggtgtcgaacaacttagtcatgagggtaattgttggtaaacgtaattttgggactaagattgttgaaggggagaaggaggctgttgagtataagaccattatggatgaactcttacgtcttgctagtttgtctttgttatccgattttgcacctatacttcgtttgtttgatcactttcaaggacatattcgtactatgaaacgaaatggcaagaaactagacgtactacttcaacggtggttggaggagcatcggagaaagatgagcacgccggaggaggagcaagatttcatggatgttatgttgtccattgttgatgagagcaagttgtctggtcacgacgctgatacggttattaaagctacttgcctggccatgataatgggtgggacggacacatcggcggtgagtctaacatggatagtctccttattgatgaacaatcgtcatgcactagcaaaggctagagaagaattggacaagcacgtaggtaaagatagacaagtagaagaatcagatttgaagaacttggtttacttgcatgcaatcgttaaagaaacaatgcgattatatccattgggacctcttctcgaacgcgaaacgaagcaggattgcgaggttggaggattcgatatcgccggaggcactcgtatactagtaaacatatggatggtacaaagagatccggccgtctggaacgacgcgacggagtttataccggagcggtttctaacggagaaatcggatgtagatgtttggggtggtagttttgagcttataccatttggagccggccggagggtgtgccccggcgtgtcgtttgctctacaattcttacatttagtattggctcgtcttatacatggatatgaattgaaaacgccaaatgatatgccggtcgacttaacggagagtactgaagggcatgttaaccataaagcatcacctttggatcttcttctcgtccctcgccttagcgacctgaagctctatgattactag

SEQ ID NO: 182 - DNA, 1614 bp, Glaucium flavum
atggattccattcttacaaccgttgttctcctttccatacttctctactttctattctcatggcagctaaacaaatactctgctactaagaagaataccaaatcatcaaaacagctaccaccagaaccggctggttcatggcccgtcattggtcatctccatcttctcgccaaaggatcaaacttgccccatataaatttgggagccatggctgacaagtatggaccaatcttcatgatccgtatcggcttaaatccaacactggtggttagtagttgggaggtagcaagagagatattcacaaccaacgaccaagttttctcctcccgtccaattcaagtatccacgaaacacttgggtttcgacactgctatgtacggtttcgcaccttatggaccatactggcgtgaaatcagcaaattagtgaagcgtgaagttctatccaacactagactagagttcctaaagcctgtttggggctctgagatcaacacatctatcaaagaattgtatgatgtgtgtgtaatgaaaaacaaagaagaaggtggtactggtccaattattgtggaaatgaagcaatggttctcagatttagcattaaacatgtcggttaagttggtagccggtaagagatattttggtgcttctcaactaggaaatgaggaagctgcgaggtggcaaaaggcactgagaaactgctttaggttggtggggctgtttgttgtgtcggacgcaataccatttctaaggtggttggacgtgggtggtcacgaaaaagaaatgaagaatactgctaaagagttggacgatttgttggagggatggctggaagaacataaaatgaaaaagaagttatcattaagtgaagttgaagctgagaagaaggaaagggatcgggttgacttcatggacgttatgctgtccacacttgaacatgaaaaggcatctgactatttcccggctgatactatcaacaaggctacttgcttggctctaatccttggtgggactgatactaccacagttgtttgggtttgggccttggctctactagtgaataacccgaatgtgttaaagaaggcccaagatgagttggatgtccatgtaggtaagaaaagacaagtggatgaatcagacatcaaaaaccttacatatctccaagccataatcaaggaatcaatgcgtctctacccagcagctacattaggtataagagaatcaacagaggattgcactgtagctggctaccacatccctgcagggactagtttgatagtgaattcttggaagattcaacatgacccacaagtatggactgacccatttgaatttcagccggagagatttctcacaggccacatggacgtcgatattagaggtcagagttgcaaattcctcccttttgggtcgggtagaaggtcatgtccagggacatcactcgctcttcaaatggtaaccttgacacttgctcgtttgatccatgggttcgagttcaggactccgtcagaagcacccactgatatgacagagagcgctggactaactaatgttaaggccaccccacttgaagttctagtctcaccgcgccttccttcggagctttatgtttgttaa

SEQ ID NO: 183 - DNA, 1614 bp, Glaucium flavum
atggagttgatcaactctcttgaaatccaaccaattacaatatccattttagctcttcttactgtgtccattcttctttacaaaattatttggaatcatggaagcagaaaaaataataagagcaacaagaacaacagaaagacatcatcatcagctggagtagtagaaataccaggtgcatggccaatcatcggtcatctccatctcttcaatggaagcgagcaaatgttccataaactcggttccttggccgaccaatatggtccggcgccattctttattcgatttggttcgcgtaaatatgtcgttgttagcaattgggagctcgttaaaacatgtttcaccgcacaaagccaaatctttgtaagccggccacccatgttagccatgaacatcttgtttttcccgaaagattcgcttagttatatacagcatggtgaccattggagagaattgagaaaaatttcaagcacgaaactactttccagtcaccgcgtcgaaacccaaaaacatttgatagcatcagaagttgattactgttttaaacagctttataaactttccaataatggagagtttaccttggtgaggctgaatacttggtgtgaggatatggcattgaatgttcatgttagaatgattgccgggatgaagaattatgttgctgcacctgggagtggtgaatatggcggtcaagctcggagataccggaaagctttagaagaagctcttgatctactgaaccagttcactatcactgacgtggtgccatggttggggtggttggatcattttagggatgtggttggaaggatgaagcgttgtggtgcagaacttgattcgatttttgcgacgtgggttgaagaacatcgtgtgaagagagcctctggaaagggaggtgatgttgaaccggattttattgatctttgctgggagagtatggaacaattgcctggcaatgatcctgcaactgtcatcaagttaatgtgtaaggaacatattttcaacgggagtggcacctcgtcactgaccctagcatggatcctttctttaataatgaataatccctacgtgataaaaaaggcaagggaggaattggaaaaacacgtcggaaatcatcgacaagtggaagaatcagatctccctaatctcttatacatccaagcgatcatcaaagaggggatgagattgtacacaccaggaccattcattgatcgaaatacaactgaagattatgagataaatggtgtccatataccagctggtacttgcttatacgtaaacttatggaagattcaccgagacccgaatgtgtatgaagatccactcgagtttaaaccagagaggttcttgaagaacaattcagatttggatctaaagggacagaattaccaactcctaccgttcggggcaggtaggaggatatgtcccggtgtgtcgttagcgttgccgttgatgtatctgacagtgtctcgactcattcatggcttcgatatgaagttgcccaaaggtgttgaaaaggctgacatgacggcacatggaggtgtaattaaccaaagggcgtaccctttggaggtgctgctcaaaccacgtctcacctttcagcaagcttaa

SEQ ID NO: 184 - DNA, 1716 bp, Glaucium flavum
atggatttacaaatcttcttccacttccaaggaattgtaggctcattagctttactatcattcttctattatctatggagacttttaactacgacgaagacgagtatttgtaacggtacaacggctgcaccacctgaagtttccggtggttggccgatactgggtcatcttttgcagctagtaggatcgaaacagccgttgttcaaggttcttggagacatggctgataaatatggacctatttttgttgtccggtttgggatgtacccaactcttgttgtgagcagttgggagatggcaaaggagtgcttcagtaccaacgatagagtcctagctactcgtccaactagtgctgctagcaagtaccttacttacaactatgccatgtttgctttcacattttatgggccttattggcgtgagattcgtaagatatcaactatagaattgttgtcccatcgacgtgttgagatgttcaagcatgttccgttcatggaaatcgatacgtgtatagaacaactatatcttctttggatgcagaaccagaaccagaaccagaaccaaccgaacggagatccggttcaggtaaacatgagtaaagtatttgaagaactaactatgaatgcggtgttgaagttagtcgtcggaaaacgccttaccgacgacaaagaaggcgaaaagctgcacaagaccattcaagaattctttaaactgttagaggtatcagttgcatcggatgtttttccattccttgggtggctagatgtggatggacaaaagagaaaaatgaaaagggtagctaaggagatggacataatagctgaaaaatggcttgaagagcaccgccaaaagagaagtagtaagttggaggaggaggaggaggaggaggaggacgacggcggcggcaaaggagacgcggcggcggcagataaggatttcatggacgtgttgttatccttattggaaggagatgaaggtgattctgatcaacccttcatgaactatagtcgcgatacagtcatcaaagccacctctctgaatatactcgtggctgctacagacactacatcacctaccttaacatgggctatctcattactactcaacaacccccatgtcttaagagaggcccaaaatgaactagacatgaaggtaggaagggatagacaagtcgaagagcaagacattgagaacctaatctacctccaagcaatcgtcaaagagacactccgattgtacccagctggtcctctctctatcccccatgaggctattcaagattgtaaacttggcggatatcatgtaagggcaggtacacggttgttgctgaacatatggaagctacatcgcgacccacgcgtgtggtcgaacccacttgaattcaagccagagaggtttttaattctatcggaggaggtgtgtggttgcagtcgtggaacacaaaattttgattttaaaggccaatgttttgagtacataccatttgggtcgggacgaaggatgtgcccaggatacaactttggcatacaaatcattcacatgacactagcacgcctacttcagtcattcgagatgcagcctgcaaaagctaaatcgctaaatgatcaagatgggcctgtcgacatgagagaaggttctggcctaacacttccaaagataaccccattaaaagttctccttacaccacgcctctatggtcagctttataatcattag

SEQ ID NO: 185 - DNA, 1605 bp, Hydrastis canadensis
atggacttctccatgctcttccaatggctattggttactatggctacccttcttttcttgaattctgtttacaatgtttggtataaatcttcaaaaaacactagtattactactacgactagtaaaggaaagaaggcaccagtagctgctggtgcacggccgttcatgggtcaccttcatatgttagtagggggcaagcaattgcctcaccaggcacttggaaagttggccgatatatacgggccagctttcatcattcatattggcccaaacccagaacttgttgtaagtagttgggagcttgcaaaggagtgtttcactactaatgacaagtatttcgctaaccgtcctactaacaaagccatgaagtacttgacatacgacgaagcatccgttggctttggaccttatgggccactctgggttgaaatgcgaaaaatagctaaatctaatcttctctctcaacaaaggctccaaatgcataaacgtgtccgagtcttagaaatagacgcgttttttaaagaactccatgagctatggtcgatgaagaaagaggatggtccagtttctgtagacatgaagcaatggtttgaagaattgacacttaatgttatcaccagaatggtttctggtaaacataaatatgcaactaaggcaagacggggtgatagtgaggcgaagcaattcaaaagagtaataggtgaggcagcacattttacaggaaatcttttgctatcagatatatttccatctcttgggttcttggataacatgcaaggtcgtgtgaattccatgaagcgaacaggcaaggaacttgactccatccttagttcatgggttgaagagcatcgccaaaagaaactatcaggagagcagtcagaggatgaagagaaagactttatcgatcttacgttgtccatgatggacgaaattcagctccactcgactgactcagagaccttcatcaaagctatttgcgtgggtgtgatcctaggtgggagcgacacaacatcagtgggaataacatggatcctttctctactaatgaatcatcgcgatgttttgaagaaggcccaagaagaattggatcaacaagttggaatggacagaaaagtagaggattcagatctgaataatttggtatatctcagggcaatcgtaaaggaatcaatgcgtttgtaccaagttgggccacttattgaacgaaaggcatcacaagattgcaccataggcgggttccatgtcaaagcaggaactcgccttttggtgaacctttccaaggtacacaaagacccaactgtgtggtcagatcctttggaatttcaaccggagagatttcttacgacgcactcaaacatggaccttaagggacagcatttcgaactacttccttttgggtcaggtagacgaatgtgtccagggtacttgtttgccctcaatgaaatgtatttggtgcttgctcgtctcattcaaggctttgaactgggaactcctatggatgcaaaggttgatatgacagaaacatcaagtgttaccaactacagagcaacaccccttcaagtattgctcaccccacgcctcagtcctaagctatacgattattaa

SEQ ID NO: 186 - DNA, 1587 bp, Hydrastis canadensis
atggcctttgttgctcttattgttgtttacaatatctggtttaaatctgcagcaagcagaaataagaccagctataataacaaaacaatgagcaagacaccagtagttgatggtgcgaagcccatcattggtcacctccatttgttaatgggaggtgacctgcctcatcatgcgctcggaagattagccgataagtatgggccaatcttccttatgcacattggcgcattcccagaactcgttgtgagtagctcggaactcgcaaaagagtgtttcactaccaatgataaatatattatcaaccgtcctaccaataaggccatgacgtatttgagttacgaacaagcatctgttggttttgcaccttatgggccactttggattgagatgagaaagatctctaaatccaatcttctctctaaccaaaggattcacatgcagaagcaagtacgagtggcagaactggacgcgttctttaaagaactgtaccagctgtgtcgttcaaacgatgaaaacaacaacaacagtactagtcatggtaaagttttggtggagatgaataaatggtttgaagaactgacactcaatgtagtgactagaatgatatgtggtaaacaaaaaatgggtactaaggcaaggcttggggatagcgatgcgaagcattacaaaaaaaccattgatgaggcagcacattttatgggaaaccttgtgatctcagacgtagttccatgtctaggaatgttggacaatttactaggtcatgtgagcgccatgaagcgcacaggcaaggaacttgacacaatctttggttcatgggttgaagaacatcaacaaaagatcagactctctggttataaagatgatgctgaagaggaggagcatgactttattgatcttacattgtccatgatgaagggatcaactgacctccatggtcttgaccctgcaactttcatcaaatctatatgtgtgggtatgatccttggcggcacggacacgacatcggtggccttaacatggatcctctctctactactaaataatcgccatattttgaagaaggcccaagaagaattggaccatcaagtaggaaaagagagaaaggttgaagattcagatctcaacaatctggtctttataggagccattgtgaaagaatcaatgcgtttatacccagttgggcctcttattgaacgtgaggcaatagaagattgtcagattggtggtgtccatgttaaagccggcacgcgattactaataaacatttggaaggttcaacaagatcctaaaatttggcctaatccttcagagtttcgaccagaaaggtttctggattctaacatggatgttaagggccagcatttcgaactcattccttttgggtccggtaggcgaatgtgtccaggaatgtcgttcgccattaatgaattgaatttggtgcttgctcgtcttcttcaaggcttcgagttggaaactccaatgaatgcaaaggtagacatgactgaaacttcaagcgttacgaattataagggaacccctctccaagtacttctcaccccacgtctcagttctaagttatatatgtaa

SEQ ID NO: 187 - DNA, 1596 bp, Hydrastis canadensis
atggagtattcccatcttctcccatggctagcaacttcaatagctgccatttttgctttcatttttctcttttatgtccggaggaggaaaaacaacaaagcctttattcataatcatgccaaaaaagcacctgtggtaccgggtgctttgccgtttcttggtcacctccgcctatttactggaccgattttacctcacaaagcgcttggagcacttgcggataagtacggtccggctttcactatctatctgggaagtcatcaaacacttgtggtcagtggtcgagagttggtaaaagaatgcttcactactaatgatagattgttctctaatagacccagaagtaaggctgtcaagtacttgacttatgatgaagcctcagttggttttgcaccttatggcccactttgggttgagatgcgaaaggtttcaaaactcaattttctttctaatcaacggatccagatgcagaaacaggcactagcctcagaattgaatttttgcttcaaggatgtgtatcaattgtggttgaaaaataaggaactccccgttatggttgatatgaccaaatggtttgaagaaatgacgttaaatgtgataacaagattgatttgtgggaaacaaaactatggatctaaggctaacagtggtgaaagtgaggccaaaaggtataaacaagttgtagaaaaggcagcacatcttacatcaactgttgtgatgtcagatgtgtttccttttcttgaatggtttgataagtttcaaggacaggagaaagtcatgaaaaaagtagctaatgaatttgattcaatccttggttcatgggtcgacgaacatcgtcgaaagagacttcttcgaggcaacaatgaggaggaggaggaagagcaggacttcattgatctttccttggccatgatggaggaaactcagcttcatggtgttgatcctgataccttcatcaagtcaatgtgtttgggcatgatccttggaggaggtgacactacgccggtggccctaacatgggccctttcgctactattgaataacccagatattatgaagaaagcccaagaagaaatagaccaagtcataggaaaagagagaaaattagacgggtcggatataagtaatctggtctacctccaagccgttgtgaaagaatcaatgcggttataccaagttgggccattgattgaacgcgaaacaactgaggattgtaagattggtgacttccatgttgaagcaggcacgcgtttactagtaaacatttggaaagtacaacaagatccatgtgtgtggtcgaaccctacggagtttcaaccggagagatttctttctagtaagtcagatatggatcttaagggtcagcattttgaactaattccttttgggtcaggtagacgaatgtgtccagcagttgcttcagctctccaaatgatgcatttggtgcttgcaaaactcattcatggctttgaattaggaactcccatgaatgcaaaaatcgacatgacagaaacttcaagtataaccaacaacatggcaactcatcttcaagtgctactcaacccacgtttaaatgctaatctttatgatttttag

SEQ ID NO: 188 - DNA, 1632 bp, Hydrastis canadensis
atggcggatttcaccatgctcctccaatggttattgcttaccatggctacccttcttttcttgaatgctgtttacaaaagtattaaatcttcaaaaaacactattaatgataccagttttaaaaaaggaaagaaggcaccagtagctgctggtgcaagaccctttattggtcacctccatatgttagtaggaggcaaacaactacctcatcaagctctcgggaagttggccgataagtatgggcctgccttcatcatcaatattggtccaaacccagagcttgtcgtaagtagttgggagcttgcaaaggagtgtttcactataaacgatcggtgtttcactgatcgtcccagtaacaaagccatgaagtacttgacctacgacgaagcctctgttgggtttgcaccttatggccctctctgggttgaaatgcgcaagattgctaaatccaattgcgcatttcaacaaaggctccaagtacagaaacgtgtacgtgtcttagaaattgacttattttttaaagagctccacgagctatggtcccacgctggtgctggtgctaccggtactagtgtaattcctctttccatagacatgaagaaatggttcgaggaattgacactaaacgtgatcaccaggatggtgtctggaaaacataattatgcaactaaggcaagaaagggtgatactgaggcgaagcgattcaaaagagtgataagtgaggcagcacattttacaggaagacttctgctctcagatatatttccatcacttgggttcttggataacatgcaaggtcgtgtgaactccatgaagcgaacaggcaaggaacttgattcggtccttagttcctgggtggaagaacatcgccaaaagagagtctctggaaataaagagcagtcacctgaggatgatgatgtggaacaagattttatcgatctcacgttgtccatgatggaggaaattcagcttcactggactgacgctgacaccttcatcaaagctatctgcgtgggtgtgatccttggggggagcgacacgacatccgtgggcataacatggattctttctctgctaatgaatcatcccgatgttttgaaaaaggccagagaagaattggaccaacaggtaggactggaaagaaaagtggacgattcagatctcaataatctggcctatctcagagccattgtaaaggaatcaatgcgtttgtaccaagttggcccactgattgaacgtaaggcaaaacaagattgcaacataggtgggttccatctcaaagcaggcacacgcctacttgtgaacctttccaaggtgcacaaagacccgactgtgtggtctgatcctaatgagtttcgccccgagagatttttcaccacccacaccaacatagatatcaaggggcagaattttgaactcattccttttgggtctggcagacgtatgtgcccagggtacttatttgctcttagtgaaatatatttggtgcttgctcgtctcattcatggcttcgaattgagaactcccaatgatgccaagcttgatatgacagaaacttccagtgttaccaattacagggcaacacctctccaagtactactcactccgcgcctcagttctaagctctactga

SEQ ID NO: 189 - DNA, 1599 bp, Hydrastis canadensis
atggactacttttccatgccttaccaatggttactaacttccttagctactcttattgtctttgtttttatctggtctattactgctggaaaaacaagtactacttctaacaaagcgaaaaaggcaccgccaatagcggctggtgcatggcccattatcggtcacctccatttgataatggggggtgaactccctcatcgattgctttcgaatttagccgataaatatggcccaatcttcatgctcaactatggttcacaacctggattagttgtgagtagcttgaagcttgctaaggaatgttttgttcataatgatagagctgtttttaaacgtcctaatagcaaagccatgaagtatttcacttatgatcaagcttcatttggttttgcaccttatggaccactttgggttgaaatgagaaaagtgtctaaatcaaatcttctttctaaccaaaggcttcaattacaaaggaatcaacgtgcctcagaagttgatgcttttataaaagagctttaccaactatgtaagaagtccaacaatggtactcttatggtagaaatgaataaatggtttgaagaattgacacttaacgttgtgactagaatggtttgtgggaaaaaaaacattggggctaaagcaaggcatggtggtgataatgaggcaaaatattataagaaagttatagatgaagcaacaatatttacagctaaattggtggcttcagatttttttccttctcttggatgggtagattatttgcatggtgatgagagtgctataaagcagacagccaaagaacttgattccatcattggttcctgggtggaagagcatcgtcaaaagagactactctcgctcaataaagacgactacgcagagcaggattttatcgatattacgttgtccatgatcgaccaaactcagcaccagggtattgatgctgataccttcgtcaagtctatgtgtgtgggtatgatctttggtgggagtgacagcacatcggtggccctaaattgggctctttcaatactaatgaataatcgacatgttttaaagagggcccgagaagaaatcgacacacttgtagggaaggacagaaaagtgaacgatgtggatgttactaaattggtttatctcaaagccattgtaaaagaatcaatgcgtttatgcctagttggaccgcttcttgaacgtgtgaccgtagaagattgcgagataggtggtttttatgtcaaagcaggctcgcgcatagtggtaaacatatggaagttgcaacatgacccagacctgtggtctgatgatgttatggaatttcgaccagagagatttctcacaaccaactcaaatgtggaacttaggggtcaacattttgaactcattccttttgggtctggtagtcgaatgtgcccaggtgtaacattcgcactcgaactcatgcacttgacacttgctcgtctcattcatggatttgaacttggtacccctatggatgcaaaggttgacatgacagaaacttcaagtgttaccaattacaaggccacaccccttgaaatccttctcaccccacgccttcatcctaagctttatgatttttag

SEQ ID NO: 190 - DNA, 1605 bp, Hydrastis canadensis
atgtttatatcgatcactcaacaatccatggattcatttcaccaatatctagcaactataatttttggtgtcttttcctttgtattattcttgatctattatctaccattgaagagaagtagaagtgataaaaagagagctgctcccaaaccggtcggggcatggcctatcataggtcacttgcctatgttatcccggcaccaaccaccgcacataacgttgggaaatattgctgataagtacggaccagctttcactcttcagcttggcgtgcatcgagcattggtggtgagtagttcagaggttgccaaggagtgtttcactaccaatgacaaggccttagcttcccgcccaagctctgtggctttaaagctaatgggttataacaatgctatgtttggcttcggcccttatggttcatattggcgacaaatgcgcaaaatagttgtacttgagcttctctcaaaccatcggctccaattgctaaaacacgttcgtatatctgaggttagcacatctttaaaagaattgtaccaggtttgggcatcatgtactaataagaacgacaaaggacaagttttggtggatatgcagcaatggtttggtgacttgacactaaacgtctccgttaggatgattgctgggaagcgatactttggtgccagtgcagcatgcgacgaagatgaagcgaggaggtttcagaaggcgattaaagatttcctccatttagtaggcttgtttgtggtgtcagacgcgcttccctttctagaatggctagatattcagggtcatcagaaagccatgaagagaactttcaaagaattagatagaatacttgggaaatgggtggaagaacatcgacgaaataaattagacggtggaacgaatgtgggacgagacttcatggatgtgatgtcttcgatacttgacgatgcaaatatctctgattatgatgctgataccattaacaaggctacttgcctgagtctgatcttgggtgggactgacaccacaatggtcactctaacatgggctttatccttattaatgaacaatcaacacatattgaagaaggcccaagatgaaattgacatctatgttgggaaagataaaaacgttgatgaatcagatatagagaaactggtgtacctccaagccattgttaaggaaacattgcgtttgtacccagccggtccactatctgggccacatgaggccatagaggactgcactgtagctggttatcatgtaccaagaggcacacgcttgataacaaatctctggaagattcaacgagatccacggatatggtcgagcccttgtgagttccaaccagagagatttctcaccactcaagcaaatgtggatgttaggggccagcattttgagtttcttccattcgggtctggaagacgttcgtgccctgcgacctcatttgcacttcaagttgtgcacttagcattagcacgtgtattacaaggcttcgagtttgaaactcaatcaaatgcacctgtggatatgaccgagagcgcgggacttacaaatgtcaaagccaccccgcttgaagttctaatcaccccgcgcctccctttgaatctatattaa

SEQ ID NO: 191 - DNA, 1590 bp, Hydrastis canadensis
atggagtcgcttcaccaatatctagcagcagtcatgagttgtatctttgccttgttactcttcctctattatttcccatggaagatcagaagaagtagctctgataataacatgagaagtgcacctgaagcagctggtgcatggcctatcataggtcacttgcccatgctgggagggcaccaactaccccacataacgttgggaaacttggccgataggtacggaccagccttcactatccggcttggtgtatgccgggcactggtggtaagtagttcagaggtcgcaaaggagtgtttcactaccaatgacaaggcctttgccacccgcccaagctctgtggccgtaaagctaatgggctataactatgcactctttggcttagccccttatacttcttattggcgtgaagtgcgcaaaatagtaatactggagcttctctccaatcgtcggctagagttgctaaaacatgttcggatctctgaggtcaacacatctataaaagaattgttccaagtttgggcatcatcaaataataagaatgagaaaggacaagttttggtagagatgcagcgatggtttggtgacttgacaataaacgtagctgttaggatggttgctgggaaacgatacttcggtgctagtgttaatacgtgcgatgatgaggaggaggcgaggaggtttcaaaaggcgattaaaaatttctttcatcttgtagggttgtatgtgttatcggattctcttccatttttggagtggttggactttgagggtcatcaaaaggctatgaaaagaactttcaaagatgtggactgtatacttcaaagatggttggaagaacatcgacgagataaagagaatggtgcaatgaaggaggagcgagacttcatggatgtgatgttgtcgatccttaaagatgcaaatctctttggttacgaagctgatactgttaacaaggccactagtctgaatataatattgggtgcaacagacactacaatggttactctaacatgggccctatcgttattattgaacaatcgacacatattaaagaaggctgaagatgaaattgacatccatgttgggaaagataaagctgttgatgaatcagatatagagaaactagtatatctccaagccattgttaaggaaacattacgtctgtacccagttgctccactgttagcagcacatgaagccatagaagactgcattgtagctggttatcatgtaccaagaggcacacgcttgataccaaatatttggaagattcaacgagatccacgcatatggtctagtccttgtgatttccaaccagagagattcctcacaacccaagcaaatgtggacgttaggggtcagcatttcgagttgtttccttttgggtctgggagaagaatgtgcccagggatctcatttgggcttcaagtagtgcacttggcactagcgcgtgtattacaaggcttcgagtttgatactccatcaaataaagctatagatatgactgaaagcgcaggacttaccaacctcaaggccacccctcttcaagttctaatcaccccgtgcctccctttgaatctgtattaa

SEQ ID NO: 192 - DNA, 1593 bp, Hydrastis canadensis
atggattcaattttactaccaactccattaatggtcagtctctttgccttactattatgtctttactatttaatcatatcgaggccaaggtctagtcataatactagtactaaggaggcacccgaagccgctggagcattgcctattatcgggcacctccatttgttaggtgggcgaatattgcctcacataacattaggagccatggctgataaacatggaccagccttcatgattcgcattggtgtacatagagcattggtggtaagttcttcagaagttgcaaaggagtgtttcacaaccaatgacaaggctttcgcttctcgtcctaagcatacagcagcggaactcatgggttataattatgccatgtttggatttgcaccttacggtcctttttggagcgaaatgcgcaagataatcatggctgaactcctctccaatcgtcggcttgagttgcttaaatacatccgggatttcgaattaaaagcatctatcaaagaactatacatgacatgggagaaccacagtgttactaataaaggtcaggtagtagtagaaatgaagaaatggtttggagacttaactctaaatgtgattctaaggatgattgctgggaaaagatactttggttcaaattctacttgtgatgaaagtgaagcaaagatatgtcaaaagggtatgagagatttctttaggttattgggagagttccttgttgaggatgcaattccttatttggggtggttggacttgcaaggttttaaaaaagagatgaagaatacagctaaagaacttgatattcttcttcaaggatggttggaagagcacaaaaaaaagagggagttctctaaggatgttaaggaagagcaagacttcatggacgtgatgatgaccatacttgaagatgcaaacttctctgattttgatgctgatactatcaataaggctacgtgtttgactataatctcaggaggaagcgacactacaatgcttactctaacatgggccctatccttactactgaacaatcaacatgtgttgaagaaggcccaagatgagttggacacccacgtcggtagggatagacgcgtggacgaatcagacatcaagaacctcgtctaccttaacgccatagtgaaggaaacattgcgcttatacccagctagtccactactgggtattcgggtgtccacagaagactgcactgtagctgggtaccatgtcccatcagggacccgtttaatggtaaatgcttggaagattcaacgagacccgttagtgtggtccgacccatttgaatttcgcccagaaagatttctcacaacccatgtaaatgtggatgttaagggtcaaaattttaatttaatcccatttgcatcaggtagacgtgtgtgcccaggagttgcatttgcccttcaaatgctgccactagttctagctcatttgctacatgggttcaaactcatgactcagttgggtggacctgtcgatatgactgaatccactgggttaactaatatcaaagcaactccattggaagtagttatcagcccacgtcttcgtccagaactgtatgaaatgtacacatag

SEQ ID NO: 193 - DNA, 1578 bp, Hydrastis canadensis
atggagtcgcttcaccaatatctagcaacaattttgagttgtatctttgcctttttactcttcctctattatttcccatggaagggaagaagaagctttgataataacttaagaactgcacctgaagcagctggcgcatggcctatcataggccacttgcctatgttaaaccaacgtgatttaccccacgtaacgttgggaaacttggcggataggtacgggccagccttcactatccggcttggtgtacgccgagcactggtggtgagtagttcagaggtcgcaaaggagtgtttcactaccaatgacaaggcctttgccacccgcccaagctctgtggctgtaaagctaatggcctataactatgcagtctttggctttggcccttatggttcttattggcgtgaaatgcgcaaaatagtaatacttgagcttctctctaatcgtcggctagagttgctaaaacatgttcggatctctgaggtcaacacatctataaaagaattgtaccaagtttgggcatcaaataataagaatgagaaaggacaagttttggtggagatgcaacgatggtttggtgacttgacaatgaacgtagttgttaggatggttgctgggaaacgatacttcggtgctagtgttacgtgcgatgaggaggaagcgagaaggtttcaaaaggcgattagagattttagtcatcttgctggtttgtatgtgttgtcggatgctcttccaaatatagagtggttggactttgagggtcatcacaaggccatgaaaaaaactttcaaagatttggactgtatacttcagagatggttggaagaacatcgacgagatagagagaatggtgcaacgaagggagagcgagacttcatggatgtgatgttgtcgattcttaaagatgcaaatccttttgatttcgaggctgataccgttaacaaggctactagcctgaatatggttttgggcggaacagagactacaactgttactctaacatgggccctatcgttactattaaacaaccaacacatattgaagaaggcgcaagatgaaattaacatccgtgttgggaaagacaaacctgttgatgaatcagatatagagaaattggtgtacctccaagccattgtcaaggaaacattgcggttgtaccctgtccttccattatccgtaccccacgaggccatagaagactgcaccattgctggttatcatgtaccaagaggcacacgcttgataacaaatctatggaagattcaacgagatccacacatatggtctagtccttgtgagttccaaccagagagattcctcacaacccaagcaaatgtggacgttaggggtcagcatttcgagttgtttccttttgggtctgggagaagaatgtgcccagggatctcatttgggcttcaagtagtgcacttggcactagcgcgtgtattacaaggcttcgagtttgaaactccatcaaatgtacctatggatatgactgaaagcgcaggacttacgaatttcaaaacaacccctcttgaagttctaatcaccccatgcctccctttggaccaatattaa

SEQ ID NO: 194 - DNA, 1578 bp, Hydrastis canadensis
atggattctcttctccagttacaaataattggagcacttgctgccttaatattcacttacaaactattgaaagtgatatgtagaagtcccatgactgatggcatggaagccccggaacctccgggagcttggccgattatcggacacctccatctgctcggtggccaagacccaatagcccgtacacttggagtcatgactgataaatatgggccaattttaaaactccggcttggtgtacatactgggcttgttgttagtaattgggaactggcaaaggagtgtttcactacaaatgacagagttttagcttcacgtcctatgggtgcagcaggaaagtacttgggctataattatgcgatatttgggctcgcgccgcatggaccatattggagtgaagtacgtaagatagtattacgtgaacttctctctaatcagagtttagagaagcttaaacatgttcgaatctccgagattaatacatgcttaaagaatttattttcattgaacaatgggaatactccaataaaagttgacatgaagcaatggtttgaacgcccaatgttcaatgtggtcactatgatgattgcagggaaacgatattttagtatggagaatgacaatgaggcaatgaatttcaggaaagttgccactgaatttatgtacttaactggggtgtttgtagtgtcggatgcccttccatatctggagtggttggatttgcaaggacatgtgagcgccatgaaacgcacggccaaggaattggacatccatgttgggaagtggcttgaggagcatcgtcgtgctaagcttctgggtgaaactaaaaatgaagatgattttgttgatgtgctgctaaccatcttgccagaggacttgaaggataatcaaacgtatatacatgaccgcgataccatcatcaaggcaactgcactggctctttttttagctgcctcagatactacagctatcaccttgacatgggctctatcgttgatactcaacaatccggacgtcttgaaaagagcacaagatgagttggacaaacacgtcggtaaagaaaaactcgtcaaagaatcagacatcataaatctagtgtacctccaagctatcatcaaggaaaccttacgcctgtatccagctgcacccctcttattgccacatgaagccatggaagattgtacggtaggtggctatcatgttccaaaagggactcgaatttttgttaacatatggaagttgcagcgtgatccgcgtgtatggtttgatcctaacgagtttcgaccagaacgattcttaaccactcatgcaaatgttgattttaagggacagcattttgagtacatacctttcagctctggtagaagggtatgcccagggatcacatttagtacccaaatcatgcacttaacacttgcccatctacttcatgaattcaacatagtgacccctacgaaatcaaatgcaggggttgacatgactgagagcttaggcatcacaatgcctaaagcaactccactagaagtacttctcactccacgtcttccatctaatctgtacaatcaatacagagactaa

SEQ ID NO: 195 - DNA, 1566 bp, Jeffersonia diphylla
atggattcacttcaactcatagctagtgttgtgtgtggattgtttgccttccttcgtatctactacttactaaagaagttgtctagtaacaaggaggcaccccaactcggtggagcatggccgattatcggccacttacatctattaggccgagttgagctcccccacatattttttagtgccatggcagacaagtacggtccagccttcatgattcagcttggtatgcgacgagcactagtagtgagcagtgcggagattgccaaagaatgtttaactacaaatgataaggccttagccactcgtccaagttcaatagcagctgagattatgggttatgactatgctatgttcgggttaggtccatacggggactattggcgtgaagtgcgcaaaatagtggtcttggagtttctctctaatcgtcggcttgagttgctaaaacatgttagggtgtctgaaatatccctgtctctgaaagagttgtaccaatcctgggaaaaacaaaacaaagctgatgaaccagttttagttcatctggaccaatggtttggcgatatgacgctcaatctttcagttagaatggttgctgggaaaaggtactttggtgcaactgctgcttgtggtgaagatgagtctaggaaagttcaaaaggcaacaagggaattcgataggcttttgggtctgtttgtagtgtcggattatcttccttttctgcggtggctggacttggaaggtcaccagaagttgatgaagagcataggtagagaacttgattctattctgcagggatggttggatgagcataaaactaggaggaactctggtggaggagctaagggagatcaggatttcatagacgtaatgctttccgtccttgaagatggaaacctttccaattacgatgctgataagctcaacaaggctacatcacttacgatgattgtagctggaagcgaaactacaatggtcactctaacgtgggctgtctgcttgttgctaaacaatccggaagtgttaaacaaagctcaagatgagttggacatgcacattggcaaggacagacaagtggaagaatcagacatcaagaacctggcatacctccaagctgttatcaaagaaacgatgcgtttgtacccagttgctccactattaattccccatgaagccatggaagactgcaccatagctgggtatcatgttcgagcaggcacacgagttatactaaatggttggaagcttcaacgagacccatttatttggtctgacccttgtgagttccaacctgaaagatttctcaacaacgatgtggatgtgagaggtcggcattttgagttattgccatttgggtcaggtagacgtgcatgccctgggatttcattggcccttaatgtggtgtctttgacattggctcgtttgttacatgagttcaagttttcgaatccttcagaaggcaaggttgatatgtctgagagtgcaggggtggttgttgccaaggcaacacctctggaagtacttatcattccacgcctaccttcaaagttttacgagtactataagctatag

SEQ ID NO: 196 - DNA, 1557 bp, Jeffersonia diphylla
atgttttctcttcagttgctatcaactccattgtttggcttctttaccctgctggccatttactatctcttatggactaagagtaacaaaaccaaggaagcacctcaacctgctggagcatggccaataatcggccacctccatctactagccaggagtgaactcccccatataactttgggagccatggccgataagtacggtccagctttcatgatccgccttggtacacgccaagcaattgtagtgagtaattcagagattgcaaaggagtgcttgaccatcaaagataggatcttcgctactcgtccaagcttagtagcatttaagctcatgggctacaactctgccatggtcgggttaagcccttatggaccttattggcgggagttgcgtaagataatcgcgttaaaagtcctctcacaacgtaggctggagtctctaaaggatgtgtgggactcagaaatatcctcatccttaaaccacttgcaccaaatatggtcacaccaaaccgaacccaatggaaagattttagttgaaatggatcaatggtttggtgatctaacactaaatgtggcagttaagatggttgcagggaagagattctttagtgctgatgctgcttgtgatgaaaatgagtctagaaggtgtcaaaaggcaataagagagttctttaggcttttgggtcaatttgtagtatcagattctcttccatttctagggtggttggacttggaaggttatcagaaagagatgaagagtacagccaaggaagttgattcaatacttcagaaatggttggatgaacataaacagaaaagacaatctgcaggagctgatagagatcaggatttcatggacgtgatgctttctctcctagaagatgcaagcctctcccaatatgacactgataccatcaacaaggctacctgcttttcaatgatcgtaggtggaagtgatactacgaagatcacactgacatgggctctcaccttactactaaataatccagatgtaatgaaaaagagccaagacgagttggatatccaggttggaaaagataggcatgtcgaagaatcagatatcaagaatctagtatacctggaagctatagtgaaggaaactttgcgtttgtatccagctgctccactattagctccccacgaggccacagaagattgtattgtagctgggtataatgttcgcgcaggcacacgcttaatagtgaacgcttggaagattcaacgagaccccttgatttggccgaacccttctgagtttctaccagagagatatcttaacaaagatgtcgacgttaaaggacaacattttgaattaatcccatttgggtcaggtagacgtgcttgccctggaatcacatttggacttcaagtggtatccttgaccttggctcgtctcctccatgagtttgagatttccattgcatcaggaattaaagtggatatgacggagagcggaggtctagttactgccaaggccacccctttgaaagcacttatcgccccacgctttctttattctcatcatcacatttag

SEQ ID NO: 197 - DNA, 1578 bp, Mahonia aquifolium
atgaattcacttcagttcctagcaactccattgcttactctcattgcattactatgtgtttactgcatagtatggagaaaatcattctctagaaacggaagcaaaataaagcaggcgccctgggcaggtggagcatggccgatcatgggtcacctgcatctactagcctggggtgacctcccgcatataacgttgggagccttggccgataagtacggcccagtcttcatgatgcagcttggcatgcgccaagcaatagttgtaagcagtgcagagattgcaagagagtgtttcaccactaatgataggatcttagcaactcgcccaagctctatagcagttaagctcatggcctacaactacgccatgtttgcatttgccccgtatgggcctaattggcgtgaaatacgcaagacagtcatgcttgagctcctctccacccctcgcctcgagtcactcaagcatgtctgggaggatgaaatatccacgagtgtcaaagagttgtatgaattatgtgccagcaaaaccaaaacccatggccatgtttcagtagacatgaagcaacggtttggtgatctgacactcaatgtgttagtgaagttggttaatgggaagagatactttggtgcaaatactgattatactgaacatgaatcaaggaggtgccagaaggcagtgagggattttttcagtcttatggggttgtttgtggtatcagattttcttccatttcttgagcggttggacttgcagggttatgagaaagagatgaaaagggtagctagagaagttgatggtatagttcaagggtggttggacgagcataaaaggaagcgagagtccagtgaaaccacccacgatcaggacttcatggacgtgatgctttcgatacttaaagactcaaaattctctaactctgattatgatgccgataccatcaacaaggctacatgttttaacatgatcttaggtggaagtgacacaacaatgagcacaatgacctgggctttatcggcactgctaaataatccacatatgttgaagaaggcccaagatgagttggaattccatgtcggaaagggtagacaggtggaggaatcggacatcaagaagctaacatacctacaagctataatcaaagaaactttgcgtttatacccgtcggctcccctgttagctccacgtgaagccacagaagactgcaaaatagcggggtatcatgttccagcaggcacacgcctaatcgtgaatgtctggaagattcatagagacccatttgtttggcccaaccctaacgagttccaacctgaaagattcctaaataaagatgtggatgttaagggtcagcatttcgaattgatcccatttgggtcagggagacgtgcttgccctggggtatcattaggacttcaagtggtgtcactgggcttggcgcgcctcctacacggatttgagctttcgatcccatctggaagcaaggtagacatgactgaaactgcaagtctagttactttcaaggcaacgcctctggaagtatttatcactccacgcctatctccacatatgtatgtggagtag

SEQ ID NO: 198 - DNA, 1511 bp, Mahonia aquifolium
cttatgcatggaagaggaaaaaccatacaaaggatagcaaaatcaaagagccaccccaaccagccggagcatggccgataatcggccaccttcatctaatatcccgcggcggcctcccccatataaacatgggggccatggcggacaagtacggtccagttttcatgatccggctaggagtaaatcgagccgtgattgtgagtaactcggagatcgtaaaagagtgcttcacaacaaacgataaattcctactaaaccgtccagttgggttggccttaaacctcatgagttacaacaacgccatgttcgggttctctcggtacggtccatattggcgtgagatacacaaaatagtcatgcttgagctcctctcgagcagccggctcgagtccctgaagcacgtatgggactcggaaatattgacatccatcgaagagttgtaccaattatgtcaaacacaaaacaaggctcatgaaggcccagttttggttgaaatgaaggattggtttgcagatatggcactcaatgtgtcctttagaatggttgctgggaaaagatactttggtgcaagtgctggtggtaataaagatgaggcaagaaggtgtcaaaagaccatgagagatttctttagacttgttggcttgtttatagtgtctgatgcacttccatttcttaggtggctagacttgggagggcatcagaaggagatgaagagaacatttgaagatcttgactatgtgcttcaaggatggttggatgagcataaattgaatagaaaatctggtgggaatggtgatcaagatttcatggatgtgatgttatctactctttatgattcaaaatttaccgattacgacgttgacaccatcaacaaggctacgtgctttcaattgatcctaggaggaactgatactacaacggtcactctaacatgggccctttccttgatgttaaaccacccacatgtattgaaaaaggcccaagatgagttggacatccaagtaggcaaacacagacaagtggaggaatcagacatcaagaacctaaaataccttgaagctgtgatcaaagaaaccttacggatgcgcccagtaggcccacttttaggcccacgagaggcgatcgaggactgcaccattggtggatatcgagttcgagcaggcacacgcgtaatggtcaatgcttggaaggtgcaacgtgacccatcggtttggccaaaccctgatgacttcaaaccggagaggtttctcaagaaggatattgacttcagggaccaaaactttgaattcatccctttcgggtccggtagaagggcctgccctggaatatcatttgccgtggaactaytgcccatggctttggcccgtttactacatgggtttgagcttaagactcaattgggttgcaaggtggatatgacagagcatgccggtttagttcatgctaaggctacccctttggaagttcttgtcagcccacgcctgtctcgagagttgtatgtatcgtcttag

SEQ ID NO: 199 - DNA, 1590 bp, Menispermum canadense
atggattcaactgatcatcacctggcccttgtaatacccactcttctagctacccctgtcttattgttctccttctactgtctcctcttgagaccaaggagtctcaaaaaacctcgtactaacaaaccacctgaaccttctggttcatggcccatcatcggccatctccatctcttaagccaaggcctacctcacataacactgggagccatggccgacaagctcggaccagccttctcaatccgcctcggcacgcgccgagcactagtggtcagcagctgggaggttgctaaggagtgttacaccaccaacgaccgagccttcgcgagccgtcccagcagcatagcagtcaagctcatgagctacaacaactccatattggggttcgctccgtacggacagtactggcgcgagctgcggaagatagtggtgctccagcttctctcgaaccggaggctcgagtcgctgaagaacgtttgggaatctgagattgatttgtctataaaggagttgtacgatacatgggcaagtaatagaggaggagaagcgttaatggtggacatgaagcagtggtttggagaccttacgatgaacatagtggtgaggttggtggtggagaagcgttgttttgggagaagcgtgggtgacgatgagactgaggcgaggaggggccagagagcgctgaaagagtttttaaaactggtgggtttgtttttggtggaagacgcgtttccatttttgagttggttggatgttcaggggcatcagagagagatgaagagaatagcgagagaactggactcgctgtttcaggggtggttggaggaacataagaggaagagaagcataaaaggtgaggccaaaggagatcaggacttcatggacgtgatgttgtctgtactcgaggattctaccatcagcactgatatagaagatgacacagttatcaagtccacatgcttgactgttgtcttgggagggagcgacagcacagtgggaactctcacttgggccctctccctactcctaaacaacagacacgaattgaaaaaggcccaagatgaattggacgcctatgtgggtaaggaaagacaagtggacgaatcagacatcaagaacctcgtgtacctacaggccatagtcaaagaggttctgcgactctacccagcgggcccactatcaggcccacgagagtccgttgaggacactgtggtagcaggttaccatgttcccaaaggcacacagctcatagtgaacctctggaagattcaacgtgagccgtccatctgggccgaccctctagagtttcaaccagagagatttctcacgacccacaaaggcatggacgtgtggggccagcacttcgaattaatcccttttgggtccgggagacggtcgtgcccgggcacagcgttcgcccttcaagtgattcacctcacattggctcgtttgctacatgggttcgagctcaccacaccatgtggtgcacctgtggatatgagtgagagcgctggtctcattaatgtcaagaccacgccagttgaggttcacgtcgctccacgcctccctctcaagctatataaatcataa

SEQ ID NO: 200 - DNA, 1590 bp, Menispermum canadense
atgattttaattgcaatgggcaaccacattgaactgcaagatatcatactgtattcccttggattttttgctgctactattttatggagaatttttagtacctatgtccttagaaggaacagttgctccagaccaccagaagcagccggaaaattgccgttaattggtcaccttcatcttctaggagcgaacaagatattacatcatacacttggagacatggccgatcgacacgggccaatcttttctttgaatttgggaattaaaagaactcttgtgatcactagttgggaagtagcaaaagaatgttttacaacacaggacagggttttcgccactcgtccgaaatctttagttggaaaagtagtaggatataatagcacagttatgatatttcagcagtatggaccatactggcgcgagatacgcaagctagcaatgattgagcttctgtcaaatcgtcgactggaaatgctcaaacatgttcgggaatcagaggttaatcttttcatcaaggagctatatgagcaatggtcaagcaatgagaatggaagcaaggttgtggtggaaatgaaggaaaggtttggagatctgacaacaaatattgtggtcaggacagtggcaggtaaaaaatattctggtactggtgtgcatggtaatgaagagtcgaggcgatttcagaaggcaatgacagattttatgcacttagcggggctgtttatggtttctgatgcacttcccttgctcggttggattgatacattcaaaggatacaggggaaaaatgaacaagacagcagaagagattgatcatgtacttggaagctggttgaaggagcatcagcagaaaagaaaaaatatcagcattaatcatttagacgaagactttatccatgtcatgctctctgccatggacgggaaccagtttcctgacatcgacaccgaaactgccatcaagggcacttgtttaagtcttatcttaggtggttatgatacaacatccgccacacttacgtgggcactctccctaatcgtcaacaaccatcatgtgttgaagaaagcacaagatgaaatggacaagtacgtaggaagagatcgccaagtaaaggaatcagatgtgaagaatttaacttatttgcaagccattgtcaaggaaacactgcgattatatccagcagcaccactatcagtccaacacgaagcaatggaagattgcacggtggcaggatgtaacattccagctggcacgcggttagttgtgaacctctggaagatgcatcgtgacccgaaagtttggtctgaccctctagagtttcaaccagacaggttcctgcaaaaacatgttaatgtggacatttggggtcagaattttgagcttttaccatttggatcaggacggaggtcatgccctggtatcacatttgcgatccaggtcctgcacttgacacttgctcaattgcttcatgcgtttcaactgggaactgtctttgcctcgcccattgatatgactgaaagttcgggtgttactaacccaaaagcaactccactgcaagtaactcttaccccacgactgcctcctgaagtctactaa

SEQ ID NO: 201 - DNA, 1542 bp, Menispermum canadense
atggattcaacctaccaacttctctctgccctattgttcatcctctgcctttactatctcgtctgtaaaccaatcaccaaaacaaaaaacgacgaagctcctgtaccagccggagcatggcccatcatgggccacctccacatgctccgcggcccaaacctccctcacataaccctttcatccatggccgacaaacacggcccggccttcacaatccgactcggtacgcgccgagccctcgtagtcagcaactctgatctcgcgaaggagtgcttcacagtaaacgacaaggccttctcaacccgcccgagcaccgtagccacgaagctcatgggctacaacaacaccatgttcgggttcgccccgtacgggccgtactggcgcgagttgcggaagatagtgatgaccgagcttctgtcgagccgaagactcgagtcgctcgcgagcgtttgggcctctgagattgagtcctcggttaaagagttgttcgcggaatgggctgaaaacagggcgaagggtccagtggtggtggagatgggagagtggtttggaaacttgacgctcaacatagcgcttcgaatggtggtggggaagaggtatttgagagaagagtcgcggaaatgcttgaaagcgatgagggattatccggagctgtttgggaggtttttggtggaagacgcggttccgtttcttgggtggttggacttgattcaggggtatcagagagaaatgaagaaaacagcgagagaactggactctgttcttgaaaaatggctagtggaacataaagataagagaggttctggggaggggaaaggagagcatcaggacttcatggacgtgatgatatcggtacttgaagattcaaagctcagttacggagaggctgatacggtcaataagtcaacttgcctgaatctaatcttaggtgcaactgacacaacaatggtggctctcacatgggccctctcacttctactcaacaataaacaagtcctcaaaagagcccaacaagaactaaaatcccaaatcggcaataacaaacaagtgtcccaatccgacatcaagaacctactttatctccaagccacagtaaaagaagcactgcgactttacccaccagagccgctatctggcccgcgagaggccctcgaagactgtaccgtcgccggctaccgtgtccgagccggcacacggctgatagtgaacctgtggaagattcatcgagacccgtcgatatggcaggtccctctcgagttccggccggagaggtttctcacggcccacaaagatgttgatgtgtggggccagcacttcgagctgatgccgttcgggtcgggcagaaggtcgtgcccgggcatctcgtttgttcttcaagtggttccgttgatattggctcgtttgctacacgggttcgaactcacaacgcctggcgaggctttagtggacatgagcgagagcgcaggtcttgtgaacgccaaagtgacaccccttgaagttgttatttctccacgcctcccgctcgagctctttgcgggttaa

SEQ ID NO: 202 - DNA, 1605 bp, Menispermum canadense
atgattatgatgttcatcgactactactcctcatggcttccccaaactctactacttcaatcaattttactagctgtttccctagtcatcttcatcaatctctttctcacgaggaggaggagctactcctccaaatcccacaccaatatcatacaccctcccaaggccgccggagccctgccggtaataggccacctctacaccctctttcgaggcctctccgccggcgttcctctctaccggcaactggatgccatggccgaccgttacggccccgcgttcatcatccaccttggcgtctaccctaccctcgtagtcacgtgccgagaactcgccaaggaatgtttcactacaaacgaccaaacctttgccacgcgccccagcacgtgcgccggcaagtacatcggctacaactacgcgttcttcggcttcgcgccctacggcccgtactggcgcgaagctcgcaagatcgccaccgtcgagctgctctccaactaccgcctcgactcgctgcgccacgtgcgagaagctgaggtggggcgcaacgtggacgagctctacgccctccacgcgtcgtcatcaacgaataagcaaaacatgatgaagattgatatgaagcagtggttcgatcaggtgacgctgaacgtgattttgatgatggtggtggggaagcggtgcgtgaccactggtgggaatgaagaggaggtgagagtggtgaaggtgttgcacgagtttttcaagcacctagggactttgtcggtatcggacgtggtgccgtacgtggagtggatggatctggacgggaatatagggaggatgaagagcacagccaaggaattagattgtatattagggagatggttggaagagcaccgccgtgagaggaggagtgatttcatggacgctatgttggcgatggtggaggggattaagataccttattatgacagcgacaccgttattaaagccatttgcctgaatctcctcaacgctggatccgatacccttggcatcacgatgacctgggcactgtcattactccttaacaaccgccacgtgttgaagaaagtcaaagatgagctggacgtccacgtgggcaaaaaccgacaagtggaagagttagacgtcaagaacttggtgtacctccacgctgtcgtcaaggaaacgctgcgcctcttccctcccgcgccacttggcgtgccacacgaggccatggaagactgtgtcgtgggaggcttccacgtggcaaaaggtacacgtctcgtcgtgaacgtgtggaagctgcatagagatcctagcgtctggtccgaccctctggcgttcaagcccgagaggttcttggacaacaacacggttgacgttagaggtcagcacttccagttattgccattcgggtcgggcaggcggggctgcccgggaatcacgttcgcgcttcaggtggcgcacctgacgctcgctcgattgctgcatggattcgagtgggacacaccggatggtgcgccggtggacatgagcgaggtctcggtattgaccacggcaaaaaagaaccctgttgaggttttgttcactcctcgtcttccggcagaggtctacacgcaaaattag

SEQ ID NO: 203 - DNA, 1572 bp, Menispermum canadense
taccaattattattccttcaaaccgccattgcaggcctactgttcgccttagcactactagtgcgccttcgcttctcgaggcgtaacaatggcaagaagaagcaagcaccaccagaaccagccggagcacggctcatcatgggccacatccacatgctcaacagtggcgagcagcctcacaagaccctcgctgcactggccgaccaatacggcccagtcatcaagctccgcctcggcctacgcgacgccatagtagtaagcaattgggagatggccaaggagtgtttcaccactaatgacaaaatcttccttagccgtccccagaccgtcgtgtcaaagttcatgagctacaacctcaaaatgctcggcttcgctccttacggcccgtactggcgtgagattcgcaagatagtggtgtctgagctgctctcgaaccgccggctcgagctgctgaagaacgcgtggacctctgagatcagctcgtgggtgaaagagttgtttgacgagtggggtgcgaaggaggcgagagggcctgttgtggtggacatgaggcattggttcgggaacttggcgttcaatatagggatgaatatggtggctgggaagaggttttttgggccgagagtggtgtctgacgaggacgggttgcggcgagtccagcaaggcctcacggatttctttaggctaataggcgcgttcttgttggaggatgcggtgccgtttctaagctggtgggacagtcaggggtatcagaaggagatgaaggacactgcgagagagatggatacactgattcaaggattgttggacgagcataaacgtaggagatcatcaagctctggtgaggccaaaggggagaaggacttcatggacgttatgcttaatattcttgaaggttcaaagttccccagtggagacgctgataatatcaacaagtctacttgcttgtctctaatgctcggcttgacggacacaacaacggcgaccctcacatgggctctctccttgctacttaacgacccgcgtgtcttaaagaaggctcgagaagagctggatttccacgtcggaaagaacagactggtggacacatcggacttaatgaacctcccatacatccacgccatagtcaaagaagtgttgcgtctccacccaccggcgcctctctccggccaccgtgaatccttggaggacagtgtggtgggcggctaccatgtccccaagggcacccgctttatggtgaacgtctggaagatccaccatgacccgaataagtggcccgaccctattgagttccgacccgagaggtttctgaccacccacaaagatgtggaagtgtggggccagaactttgaactgattccgttcagttcaggaagacgagtgtgtcccggggcttcgttgtctctacaagtgcttccgttcacactggctcgagtgttgcaagggttcgaagttgcaacaccaggaggtgcgccggtggatgtcacggagagcaaaggcctctcaactgctaaagagactccgcttgacgtcgtgatcactccgcgtctccctgaaaagttctaccattga

SEQ ID NO: 204 - DNA, 1587 bp, Nandina domestica
atggattcactcatttcatttcaagcaatagttgggcttttcatcttgatcctagtttcctatcaatggcttggaaggtctagaagtattaagactaacaagcataacgaagcaccggaaccagccggcagatggcccatcatcggtcatctacatttactcggagggtcggaccaattactctatcgaacgctagggtccatggccgataaacttgggccggcattcaatatccggcttggtagccgtcgggcctttgtcgttaacagttgggaggtggccaaggagtgtttcaccatcaatgacaaggcccttgctagtagacccatcactgtggctgcaaagctcatgggctataactatgcagtctttgggtttgcaccatacagcccattttggcgagcaatgcgaaaaatagccacacttgagcttctttctaatcgtaggctcgagatgctcaaacatgttcggatctcggaggtggacatgggcttgaaagaaatttatgggctttggtccaagaacaaggattcaggccctttaatgattgaactaaacaggtggtttgagaacttgactctaaatatggttgtgagaatggtggctggcaagagatattttggtgctgatgcatcatgtgatgagaacgaagcgcagcgctgccagaaggcaatcagtgaattcttccgtctcattgggatatttgtagtatccgacgcgattccttctctatggtggttggatttgcaggggcatgagaaggccatgaaaagaactgccaaggacctggattctatactaggaggctggttggagcagcatcggtcgcggagagtcaatggtaaggtcccaaccgagggggaacaagacttcatcgatgtgatgttatcgctacaagagggcgatcatctctctgattttgagtatgatgctgatattgccatcaaatcaacttgcctggcacttatcctaggtggcagtgacaccactgcaggtaccctaacttgggctatctcattgctactaaaccatccctatgctttgaaaaaagcccaagaggaattggacctccatgttggcaaggacagacaagtctatgatcaagacatcaagaatctggtatatcttcaagccatcatcaaagaaacactgcgcctatacccagctggtccactattgggcccaagggaggccatggaagactgcaccatatcagggttcgatgttcgagctgggacgcgcttggtggtaaatgtttggaagattcaacgagacccaaacgtgtggtcgaacccatctgagttttcacctgaacggtttttgacaagccatgtggatgtcgatgttaggggacaaaatttcgagctcatgccatttggatcaggccgacggtcttgtccaggcgcttcatttgccctccaggtcctgcatttgacattagcccgttttcttcatgggtttgggttggcaaacccattgggaaaacctgtagacatgaatgagagcccaggactaactatcccaaaagcaacacccctaaatgtgctgctcactccacgtcttgattcagagctatatggttgctag

SEQ ID NO: 205 - DNA, 1563 bp, Nandina domestica
atggaaacctttcagttccttggaattccattgtttggcttctttgccttattatgcacttactacctagtattgaggaagccatcatccactaagatcagggagccacctcggccagccggagcatggccaatcatcggccatctccatttacttgcccggggtgacctcccccacgtaactttggggaagatggctgataaatatggcccagtcttcaagttaaagcttggtgtccgacaagcaattgtggtaagtgattgggaggtcgcaaaggagtgttacaccaccaatgatcgtgccttagccaatcgtccaagtggcctaggagcaaaaatcatgggctacaactatgctttgattgggtctgccccctatggcccatattggcgtgatttacgcaaaattatcacgcttgaagttctctcgagccgtcggcttgaatcactcaagcatgtatgggactctgaaatatccacatctgtaaaagaattgtaccaaatatgggcagatcaaaacaaagctcaaggccaagtttctgttgaaatgaaacaatggtttagtgatatgacactaaatgtggcagttaggttggctgtcggaaagaagtacttaggtgcaactgccgattgtgaaaagaataaggcagtgcaatgtcaaaaggccatcaggaattttttcagactcgctggtttgtttgtggtggcagattaccttccatttctgggctggttggacttgggagggcacgaaaaagagatgaagcacacagcaaaagaactcgattatatagctcaagaatggttggatgatcataaaaagaagagaacctccaatcggacagtggacgagccacaggatttcatggatgtgatgctctcgatcttggaagaatcgactttcacgggttatgatgttgatatcatcaacaagtccacatgttttgcattgatcctaggtggaacagacactgtggcagttactctgacatgggctctctgtttattactgaacaatccacatgtactgaaaaaggcccaagatgagttggacatccacgtcggcaaggatcgacacgtcaatgaatcagatatcaagaacctcgtttacctccaagctatgatcaaggaaacattgcgcttatatccagctggtccgctactaggtccccgtcaggtcattgaggactgcaccatagctgggtaccacgtacgagcagggacacgtgtgatagtcaatgcttggaagtttcaacgagacccgtcgatctggtcaaacccttgtgagttccaaccggagagatttctggacaaagacatcgatgtgaagggtcaacacttcgaattgatccccttcggagcaggcagaagggcatgccccggaatctcctttgctcttcaagtattaccattggcattggctcgtttactacatggttttgagcttaaaaacccatcggaaagccaagtggatatgactgagacccccggtatggttcatgccaagacaacccctttggaagtacttatcacaccgcgcttgtctccaaaattttatgtataa

SEQ ID NO: 206 - DNA, 1488 bp, Nandina domestica
tggaagaggccaacctctgttaagtacagggaggcaccccaaccagctggcgcatggcctatcatcggtcatctccatttactggcccgtggagacctacaccacataactcttggagccatggccgacaagtacggcccagctttcatgatgcggcttggtgtgcaccaagcaatggtggtgagcgattcggagtctgcgaaggagtgttccaccaccaacgatagggtcttggccactcgaccaagtagcgtagctgtaaaacttatgggctacaactatgccatgtttgggttcggcccctatggatcatattggcgtgaaatacgtaaaatagttattcttgaggtcctgtcaaaccatcggcttgagtcactaaaacatgtatggaagtctgaaatatccatgtccaccaaagagttgtaccaattatggataaaccaaaacaaggatgaaggcccgactttggttgaattgaagcaatggctttgtaacatgacactaaatataggagttaggactgttgctgggaaaagatactttggcgcaagttcttgtgatgcaaatgaatcaaacaggattcaaagggcaatcagagatttctttagatttgtaggtttgtttgttgtgtcagattttcttccttttctagggtggttggacttggaaggttatcagaaggagatgaagagtattgctagggaacttgattctatccttcagggatggttggatgaacacacaaggaaaagacaatctggtgggaccaacgaaaatcaggattttatggacataatgctttcagttcttgaacattcgaatgcattgactcactatgatgcagatacaatcaacaaagcgacatgctttacaatgatcttaggtggaagtgatactacaatggtcactctaacatgggccctctccttgttactgaacaatccacatgtcttgaaaaaggcccaagatgaaatagatatccaagtaggcaaggacagacttgtggacgaatcagatatcaagaacctagtatacctccaagctatagtcaaggaaactttgcgtctgtacccagctgttccaataataactccacatgaggccatagaagactgcaccatagctgggtatcatgttccagcaggcacacgcctcattgtgaacgcttggaagatacaaagagacccattgatttgggataaccctggtgagttccaaccagagagatttctctacaaagatgtggatgtgaaaggtaaacatttcgaattaatccctttcgggtccggtagaagggtgtgccctgggatctcgttggccctccaagtggtgtcattggccatggcccatctcctacatgagttcgaccttgcgaaaccatcagaaggcaatgtggacatgactgagagtgttggtttggttaatgctaaggcaacccctttggaagtacttatcactccgcgcctatccccaaagttttatgaatag

SEQ ID NO: 207 - DNA, 1578 bp, Nigella sativa
atgggttccttcaaccaaataaatccatctgttgtatactttgctgcctttaccatcttcttcttcttctttctctataaaatattatacaagagaagaaccagtgcgaagaccagagttgctcctgaacctgctggtgcgtggcctttcataggtcacttacccttgctatcccagcaaaacttgccccatgtaacattgggggtgttggctgacaaatacggaccagctttcactgtccaactcggcttacacaaagctgttgtggtgagtagttgggaggttgcaaaggagtgcttcactgtcaatgacaaagtgctcgctactcgccctagctcagttgcagtgaagattatgtgctataactatgctgtgtttggctttggaccatatggttcctattggcgtgaagctcgcaagatagttgtacgggagcttctctcaaaccatcggcttaatttgctaaaacatgttctggtcactgaaattagcatgtctatgaatgaattgtacacagtttggcaaaagaatgctaataatgttagtggaaaagctttggtggagatgaagcaatggtttggtgacttgtcattgaacatgattgtcaagatagttgctggaaagcgatacttccaagctagtgcaaattcagatgaaagggatcagttgaaaaggggagtgcaagatctcttccatttggttgggctgtttctggtgtcagatgcacttccatttcttagctggttagacattggtgggcatgagaaagccatgaggagaactgccaaggagcttgacaacatactggggagttggttggatgaacataaacaggctaaattggcaggggcgacaaagggagagcaagactttatggatgtgttgatgtccatactagaggataacaataatctccctgagtatgaaccagatgttgtcagtaaagctatttgcttgggtatgattttgggtggagctgataccacaacaattactctgacgtggattgtgtccttactactcaacaatcaacacattttgaagaaagcccaagatgaaattgacagcaaagttggaaaagatagacaagtaaatgaatcagacatagaaaaactggtatacctccaagcaattgtgaaggagacattgcgtctgtacccacctgctcctctgtcaacacaacatgaagccatggaggactgcaccatagctgggtatcatgtccaagctggtacaagattgataacaaatatatggaagattcaaagagatccaggggtatggccgaatccttgcgagttccagccagagaggtttctcactacccatgccaatgtggagtcaaatggaaagcattttgagtttattccatttggatctggtcgacgggcgtgcccaggtatgtcacttgggcttcaggtggtgcacctgacattagcacgtctgctacaaggttttgaattggaaactccgttgagtgtggaagtagacatgactgaaagtgctggacttacaaatctcaaagtaacgccccttgaagttttaatcaatccgcgtctaccttcaaatctatactag

SEQ ID NO: 208 - DNA, 1554 bp, Nigella sativa
atggatttgacaagcatcttgatttgtatctttcttttcatcatttctatctgctttctgtcatggaagcgatcaaggagtctttccggaaccagagcagctccggaaccagttggtgcatggcctgtcataggccatctaaggctgctaatggggtccaaaacacctcatatgaccttaggaaacttggctgacaactatgggccggcattcaccatccggcttggtacgaagaaaacactggttgtaagtagctgggaggtggccaaggagtgtctcactaccaacgacaaagccttcgctggccgccacagcactatggcggtggagataatggggtacaactatgccttcttcagcttaggtcctagtggtcaatattggcgtgaaattcgcaaaataacagtttctgaacttctttcaaatcgtcggttggagttacttaaacacatatggagctcagagattaagacttctatcaaagaattgtatgaaatttgtgcagcacaaagtcaatatgggaaaaaacagtctcctatggtagaaatgcagcaatggtttagtcatttgaacttgaatttatcagcaagaatggttgttggaaaacgatattttgctgacggtgttgaagaaaatgaaggcgatatcagacgatttcaaaatgcaatcaaggagttcttttactgggctggagcgtttataatagctgatacaattccatatctaaggtggatggatttcttaaatgagcggtcaatgaaaagaacagcaaaagaaacagaccatgtacttgaaggatggttgcaggaacacaaacgaaacaggctgaacggtgtaacgaaggagcaagatttcatggatgtgctgctgacagaacttggtgacaaagatctgtgtggttacacagctgatgttgtgaacaaggccacttgcctgaacatgatttttggaggaacagataccacaaaaacgggcatgatatggactttatcattaattctcaacaatccacaagtactaaagaagttacaaaatgaaattgacatccaagttgggaaagacagacaggttgatgattctgacatagggaatctcgtgtacctacaagccactgtcaaggaagcgatgcgcctgtatccacctgctaccatatttggacgtgaatccatcgaggactgcactgtggctgggtaccacatccaagctgggacacgtttgattgtgaatgcatggaaaattcaaagagatccaaatgtatggcccaatcctgacgaatttcagcctgagagatttctgacaaaccaagcagatgtggacttcaggggtcaagattttgagctcattccttttggggctgggagaagggcgtgtcctggtatttcattgacagttcgggttacacatttgacactggcatgtttgctacaaggcttcaactttgaaacccccttgaatgaacctgtagatatgtccgagaaatatggtttaaccaactcaaaggcaacccctctgaatgttatactcacaccaagactcccttccaatttgtactag

SEQ ID NO: 209 - DNA, 1593 bp, Nigella sativa
atggattcaatatttcatatgtatgcaccaattaatatccttgctgctacctttgtttttattgtcatttctgtgtggtttctgttatggatgaagagatcgagaaagaatagcaagagcagaagagctcctgaaccggtagggggatggcccttgataggtcatttgcgcttgttagtcggccctgagttgccccatgtaatattgggaagcttggctgacaagtatggaccagctctctccatccggcttgggatgcgtcaagcattggtggtcagtaattgcgaggtagttaaagagtgtctcaccaccaatgacagatgcttctccactcgccctagctctgtcgcagtagagttaatgggatataactatgcgtcgtttggtttaggtccttacgggggcttctggcgtgaagttcgcaaaatcgcaattcttgagctcctctcaaatcatcgtttgaagtctcttaaacatgtatggatatctgagattagtggttttgtcaaagaactgtaccaattatgtgtagctaatggcaatacaggaaggcaatctgctttggtggaaatgcgacagtggttaaatgatttgacactaaatgtgtctgtcagaatggttgttggaaagcgatactttggctctggtagtgaacatggtggtgaagatgtcaagcggtttcaaaaggcaattaaagatttctttcgtttggcaggaaaattcacgctggcagatgcaataccattcctaaggtggttggactttggtcatgaaagagccatgaagaaaactgccaaagagttggactatgtacttgcaagatggttggatcaacatcaaaagaacaaactcaattgcgaaacaaagcaggtggatcaagatttcatggatgtcatgttgactgtccttggtgataaagatctgtatggtttcaaggctgatgttgtcaataaggccacttgccttaatttgatcttaggtggggttgacacgacgtcagtgaccctaacatgggcattgtcattgctactaaacaatccaaacattctaaacaaggcacaagaagaaattgatgtccagattggaaaagatagacaagttgatgacaatgacttgggaaaactagtgtacctagaggcaattgtaaaggaaacaatgcggttatatccagcaggtccactgtcaggtgcacgagctgcgatagaggactgcatggttgcgggatatcatgtaccaaaaggaacacgactgattgtgaatacatggaagatacagagagatccagagaaatgggacaaccctagtgagtttcggccggagagatttctgatcaccaccaccaatggccatgtggaagtgtggggtcaacattttgagtacattccttttggatcagggagaagaatttgtcctgccatctcattttcacttcagttggtgcatttgacattggcccgattgctacaagccttcagctttcaaacaccatcaaatgcagcagtagacatgactgagacccctggcctggtcaatttcaaagccaccccgctccaaattttactcactcctcgacttccttccagtttatactaa

SEQ ID NO: 210 - DNA, 1584 bp, Nigella sativa
atgctcagtattcatgattcaaccatggtttttctccaactacaagctatttgtggcatttttggcttcattttcattattacatggtggacaagatggaaaagttccaacaaaatgaaagcaccagaagtagctggtgcatggcctgtaattgggcacctgcatctgcttgggggcggccgtcccttataccagctccttggagacatgtctgataagtatggaccagcttttaccctccgaatgggaatccaaaaggcacttgtagtgagcagctgggaagttgcaaaagagtgtctaaccaccaatgacagagctcttgctacccgcccatcttcggctggagggaagtacatgggttacaacaacgcacttatccccttcagcccttatgggccatactggcgagacatgcgcaagattgctacacttgagcttttatctaatcatagactagaggagttgaagcatgtccgagaaatggaaatcaacacttgtatcagtgacatgtacaaactttgtcaggttgaggatggagttgaaattaaaccaatttctgtagatctgagtcaatggtttgcagatcttaccttcaatgtagtggtgatgatgataacaggaaagagatatattgggtcaactgatgcaggtgacatgaatgaaataagacattttcaggcagcactggttaaatttatgaggctattgagaatctctcttctggtagatgtatttccagttctacagtggattaattatgggggattcaaaggagtcatgaaatcaactgctagagatattgattccgtacttgaaaattggctgcaggagcatcagaggaaaagactttcccctgatttcaatggaaaccatgattttattgacgtgatgatatctaccttagaaggcacagaattctctgattatgaccacaatactatcataaaggcaatatccatggctatggtcgtgggcggcactgatactacaactacaacacttatatgggctatttcccttctattgaataatcctaatgcgatgaaaaaagttcaagaagagttggagatacatgtaggcaaggaaagaaacgtagacggatccgacatacaacatttggtatacctccaagctgttgtgaaggaaactctcaggctatatcctcccgttccactctcagtaatgcaccaggccatggaagactgtgttatcggaagttacaacattcaagcaggtacgcgtgtacttttcaatctctggaagctacaccgtgactcgtcagtgtggtctgatcctttagaatttcgaccagagagatttcttactagccatgttgatgtagacgtcaggggtcaacattttgaactgataccttttgggtctggaagaaggtcatgccctgggatttcatttgctcttcaggtcatacacttgacaatagctcgcttatttcatggattcaatctgacaacacctgggaattcatcagttgatatgagtgagatttctggagctacattatcaaaagttactccattagaagtactagttactccacggctgtcttccaagctttacaattga

SEQ ID NO: 211 - DNA, 1566 bp, Nigella sativa
atggatttcttgatctacgttgctgcctttgccgccgccttcttcttcttattgttctacaacatattatccaagagaataaccggtacaaagagaagaattgctcctgaacctgctggtgcatggccttttattggtcacttgcccatgctcttcgggcccaacttaccccatgtaacgttgggtgccttggctgacaagtatggaccagctttcactatccagctgggcttacacaaagctcttgtggtgagtagttgggaggttgccaaggactgcttcactgtcaatgacaaagccctcgccactcgccctacctctgctgcagtgaagattatggcctacaactgtgccgtgttcagtttctcaccatatggttcatactggcgtgaagcacgcaaaatagctatacttgagcttctttcacaccataggcttgatttgttaaaacatgttcggaaatctgaagtaagcacatctataagagaactgtaccaattttggcaaaaaaatgctacggaagttactaaatttgctcagctggaaatgaagcaatggtttggtgatttgacaatgaacctgattgtcaggatggttgctggaaaaagatatgctagtgttcaatcagatgatgatggtgaggggaaaaggctacaaaaggccgttaatgatttcttccatctagtagggttgtttgtggtatccgacgcacttcccttccttggttggttagatattgggggcaacttgaaaaccatgaagaaaactgccagggaacttgacagcataatggagtgttggttgaaggamcatcaagctcggagatcaaatggggagcaagatttcttggatgtgatgttgtccatactgcgtgaagataataagctgcaagagtatgatggtgatgttgttgtcaaagctatgtgcttgaatatgattttgggtggagctgatagcacaacaatcactctaacatggaccatctccttactacttaacaacagacacattttgcagaaagcccaagacgaaattgacagcaaagtggggaaagatagacaagtgaatgaatctgacatagagaaactagtataccttcaagcaattgtraaggagactttgcgtctgtacccacctgctcccctatcttcacaacatgaagccatagaggactgcacaatagctggctaccacatcccagctggtacaagattaataacaaatctatggaaaatccaacatgatccaagtgtatggcacaatccttccgagtttcagccagagaggttcctcactacccaggcgaatgtggactttagaggtcagaatttcgagtttattccatttggatttgggcgacggtcatgcccaggtacctcacttggtcttcaaatggtgcacctgccattagcacgtttgctacaaggctttacatttgaaacaccatcaaatgcagctgtggacatgactgaaagtgctgggcttacaaatcacaaagtaacaccacttgaggttctaatatcaccacgtctccgtttcgatctttatcaagaatctcccccttga

SEQ ID NO: 212 - DNA, 1580 bp, Nigella sativa
attccttcaaccaaacatatactggttttatctgcttatctgtctttgcctccttcttcttcttcttcctttacagcgtgcagcagaagaggagaacaggtagaaaggccagatacgctcctgaacctactggtgcatggcctttaataggtcacttgccaatcttgttcgaacctaacttaccccatatacagttgggagccttagctgacaagtatggaccagtgttctctatcaaacttggcttacggaaggctcttgtggtaagcagctgggaagttgtcaaggagtgcttcactgtcaaagacaaagtccttgcctcccgccctagctcagttgctgtgaagataatgggctatgattatgccgtatatgcattcggaccatatggatcatattggcgtgaagctcgcaagttaactatacttgaacttctctcagaccatcggcttgatttgctaaaacatgttcgggtctctgaagttagcatgtctatgaaagaactactcaaattctgccaaaagaatgccaataatgtcagtggaaaagctttattagtagatatgaagcaatggttcggtgacttgacattaaatgttattgttaggatggttgctggaaagagctacttgggtgctagtgcaaaattggaagacggcgaacagaaacggttacaaaacgcaattcatgagtttttccgtttggcggggctatttgtggtgtcagatgcacttccaattcttagctggttagacattggggggcatgagaaagccatgaggagaaatgccagggagattgacaagataatgagcagttggttggatgaacatcgacgcaataaattggccggggtaacaaatggagagcaagactttatggatgtattgttgtccaaatttgagaatagtaatctccctggatatgaacctgatgttgcaatcaaggctatttgcttgaatatgattttaggtgcagctgataccacaatcgtcactctaacatgggttgtgtctttaatacttaacaaccgccaaattttgaagaaggcacgagaggaaattgagaataaagttggaaaagataggcaagtgaatgaatctgatatagagaaactagtatacctccaagcaattgtgaaagagacgttgcgtttatacccagctgctcctctatcagcacaccatgaatccatggaggactgcaccattgctggctaccacgtcccagccggtacacaattaataacaaatttgtggaagatccaaagggatccacgagtatggcctaatccttgcgagttcctaccagagaggttcctcaccacgcatgcaaacgtaaactataagggtcagaattttgaattcattccatttggatatggtcgaaggtcgtgcccaggtatgtcatttggacttcaaatggtgcacttagtattggcatctcttctacaaggctttgaattggaaactccattgaatgaggcggtagacatgactgagagcgctggacttacaaatctcaaagcaacgcctcttgaagttctaattactccacgtatgcctttgaatctatactga

SEQ ID NO: 213 - DNA, 1530 bp, Nigella sativa
gtaactgttatctacttatttacatttgccatcttcttctacctctacagcatattatggaagaacccaagaaagagtgcaaagaccagagttgctcctgaaccagctggtgcatggcctttcatgggtcacttgcctatgctattggaacccaacttgccccatataaagttgggagccttagctgacaagtacggaccagccttcactgtccaactcggcctccacaaggctctagtggtgagcagttgggaggttgccaaggagtgcttcactgtcaatgacaaagtcctcgcagatcgccctagctcagttgcagtgaagataatgggctatgataatgctgttttcgcctttggaccatatggttcttactggcgtgaagctcgaaagatatctacagttgagcttctctcgaaccatcgtcttagtttactgcaacactttcgaatttccgaagctagcatgtctatgaaggagctatatcaactttgtgccaataacgggaaggctttggtggaaatgaagaaatggtttggtgacttgtcattgaatgtaattgtcaggatggttgccggaaagaggtatgccaaagctagtgaagatgatgaacggagacagttacagaaggggcttaaagatttcttttatttggtaggattgtttgtagtgtcggatgcacttccaattctaagttggttagacattgggggccatgagaaagccatgaggagaaccgccaaggagcttgacaccataatggagaggtggttagatgaacatagacgggctaaattggctggggtgacaaagggagaacaagacttcatggatgtgttgttgtccatacttgaagatggcaagcttcctcactatgaatctaatacagttaacaaagctatttgcttgactatgattttgggtgcagctcataccacaacagtcactctaatttggacattatcgttactacttaacaatcgacatattttaaacaaggctcaagatgaaattgattccgaagttgggaaggatagagcagtgactgaatctgatataaagaatctagtatacctccaagcaattgtgaaggagacgttgcgtttatatcctgctgcacctctacctgcccaccgtgaagtcatggaggactgcatcatagctggttaccacgttccagttggtacaagaataataacaaatttatggaagattcaacgagatcctcgtgtatggtctaatccttgtgccttccaaccagagaggtttcttactactcattcaaatgtggactttaggggtcagaattttgagttcattccatttggatctggtcgaagatcatgcccaggtatctcacttgggcttcaaatggtgcacttggcattagcgcgtctgctgcaaggatttgagttagaaactcctttgaatctgggaatagacatgactgaaagttctggacttacaaatcttaaagtaacaccgcttgaagttgtgatcacaccacgactaccttcaaatctatactga

SEQ ID NO: 214 - DNA, 1689 bp, Papaver bracteatum
atggcgtatttgatgatcaagaaatctttccacttgttttccgatcaaccaacttcagtttccactcttatagtacttgcttttctactgacactttcacctgttattatttactatgaacagaagaagaggggtttgaggcgaaatcggacctcatcgtcatgtaccgcaattacaacgactccgttaccagaggcatcaggtgcgtggccagtgataggtcatcttcttcttttcatgaacgaaaacgatttaaatcatgcaactctcggtaacatggctgataaatatggacctattttcagcttaagattcggtagtcatagaactctagttgttagtagttgggagatggtaaaggagtgttttacaggtgccaatgacaagtttttttcaaatcgtccttcctccttggcggttaaacttatgttttatgacactgagtcttatggctttgcaccgtatgggaagtactggagagagttgcggaagatatctacacataaactcctctctaatcagcaattagacaagttcaaacacttgcggatttctgaagtggacaactcctttaaaaagcttcacgacttatgcagcaacaacaaactgggaggagaaactacatctgtggctaatcttgtgagaatggatgattggttcgcttacttgacattcaacgtaataggacggattgtcagcggattccaatcaaatgcagtgtcaggtgccacaagcagccaggaaaaatacaagcttgcaatcgatgaagtgtcaaatcttatggcaacatttgccgtttcagatgtggttccatgccttgggtggattgaccgattgactggtcttacaggaaagatgaagaaatgcggaaagaaattagatgcagtagttggggatgcagtggaggttcatcgccaaaagaaactcaaaatttctagaaataccgcaggagaacttacggagcatgaagaagaagacttcatcgatgtttgcttgtcgattatggagcaatcacagattccgggaaacaaccccgaaatctctgtcaaatctattgccttggacatgttatcgggtgggagtgacactacaaagttgataatgacatggaccctttctttgctgttgaaccatccagacatattggacaaggctaaagaagaagtagatacatacttcaggaagaaaaagatatcggataacacacctgtggttgatgctgccgatgttcctaacctcgtctacatccaagctatcatcaaagaatcaatgcggttataccccgccagcacattgatggagcggatgaccagtgatgattgtgaggttggtggcttccacgttccagctggaacccgactatgggttaacgtatggaagatgcaacgagacccaagggtttggaatgatccattggtatttcgacctgagagattcttgagcaatgacaaagggatggtagatgtgaagggtcagaattatgaactgataccattcggaacaggcaggcggatatgtcccggtgcatcttttgccttagaagtcttgcatttggtcctcactcgtcttattcttgagttcgagatgaaggcaccagagggggaaattgacatgagggcaagaccaggttttttcaacaacaaggtagtgccactagatgttctactcaccccacgcacactagattaa

SEQ ID NO: 215 - DNA, 2561 bp, Papaver bracteatum
atgaataactactcatcatcacctgcatcatcaacagaaacagcggtactttgtcatcagcggcagcagtcgtgtgcattgccaatttccggtcttcttcacattttcatgaataaaaacggcttaattcatgtaactcttggaaatatggcggataaatacggaccgattttcagtttcccaacaggtagccatagaattctcgttgtgagcagttgggagatggtaaaagagtgttttacaggcaacaatgacactgctttctcaaaccgtcctatcccgttagcttttaagactatattctatgcatgccgtggcatagactcatacggtctttcgagtgtaccttatggaaaatattggagggagctacgaaaggtctgtgtgcataacctcctctctaatcaacaactactcaagttcagacacttgataatttctcaagtcgatacgtctttcaataagctgtatgagttatgcaaaaactctgaagacaaccagggaatggtgagaatggatgattggctcgcccaattatcgttcagtgtgataggaagaatagtctgcggattccaatcagaccctaagacaggtgctccaagcagggtggaacaatttaaagaagcaattaatgaagcatcttattttatgtcgacatctccagtgtcagataacgttccgatgctagggtggattgaccaattgactggtcttacgagaaatatgacgcactgcggaaagaaattagacttggtggtagagagcataattaatgatcatcgtcaaaagagacgattctctagaactaaaggaggagatgagaaggacgatgaacaagatgacttcatcgacatttgcttgtcaataatggagcaaccacagcttcctggcaacaataaccctcctaagatacctatcaaatctattgtcctggacatgataggtgcggggactgacaccacaaaactgaccatcatttggaccctttccttgctgctgaacaaccccaatgtgttggccaaggcaaaacaagaagtggatgcacactttgaaacgaaaaagagatcaacaaacgaagcatcagtcgtggtggatttcgatgatattgggaaccttgtctacatccaggcaatcatcaaagaatcaatgaggttgtatccggtcagcccagttgtggagcgactgagcagcgaagattgtgtggtcggtgggtttcatgtaccagcagggacgagattatgggctaacgtatggaagatgcaacgagaccctaaagtatgggatgatccattggtgtttcgaccagagagatttttgagcgatgaacagaagatggttgatgtaaggggtcaaaattatgagctgttaccatttggagccggtcgacgtatatgtccaggtgtatccttctctctggatctaatgcaactggttctgactcgtcttattcttgagtttgaaatgaagtctcctagcgggaaagtggacatgacagcaacaccaggattaatgagttacaaggtggtccctcttgacattctgctcacccatcgtcgcataaagtcgtgtgtgcagttagcatcctctgagagagacatggagagtagtggtgtaccagtaatcactctgagatcgggcaaggtgatgcctgttttaggcatgggaacatttgagaaagctggtaaagggtctgaaagagagaggttggcgatattaaaagcgatagaggtgggttacagatacttcgacacagctgctgcatacgaaactgaagaggttcttggagaagctattgctgaagcacttcaacttggcctaatcaaatctcgagatgaacttttcatcagttccatgctctggtgcactgatgctcaccctgatcgtgtcctcctcgctcttcagaattctctgaggaatcttaaattggagtatgtggatctatatatgttacccttcccggcaagcttgaagccagggaagataacgatggacataccagaggaagatatttgtccaatggactacaggtctgtatggtcagccatggaagagtgtcaaaaccttggcctcactaaatcaatcggtgttagcaatttctcctgcaaaaaacttgaggaattgatggcgaccgccaacatccctccagccgtgaatcaagtggagatgagcccggctttccaacaaaagaagctgagagagtattgcaacgcaaataatatattagtcagcgcagtctctatactgggatcaaacggaaccccatggggctccaatgcagttttgggttctgaggtgcttaagaaaattgctatggccaaaggaaaatctgttgctcaggttagtatgagatgggtttacgagcaaggcgcgagtcttgtggtaaaaagtttcagtgaagagagattgagggaaaacttgaacatattcgactggcaactcaccaaggaagacaatgaaaagatcggtgagattccacagtgcagaatcttgagtgcttattttttggtctcacctaaagggcctttcaaatctcaagaagagttgtgggatgacaaagcttg

SEQ ID NO: 216 - DNA, 1623 bp, Papaver bracteatum
atggagttcttgatgaagttattattgttacttgaaccaatcacttttagtatttttcttggtataggttctattgttcttctatacaatgtcttcttcttggttattaacaagaaaaagaagaagaaagcaccaaatgcatcaggggcatggccgttgataggccatctcaatcttttcatgaatgataaggaagcgttgtataaaacactaggaaccatggccgacaagtacggacctgcattcaacgttcgattaggcaaccaagaaatccttgtggtgagtaattggaagatggtaaaagaatgttttaacactcaaaatgataagctattttcgaatcgtcgaactacattgggtgtgaaatacatgcttaacaagaagacctctgttgccttttcaccatatggaacatattggagggagctacgaaagctaacggtgcaacaattgctctctaagcaacgtttagattcgtggaaacatttgaaaatcaaagaaatagatgcttcatttggtagacttaacgatttatgcagcaacaacaagggtactggagcagctaccccaattaggatggacagttggtttgccgagttgacgttcaacgtgttcgcaagaattgtctttggctaccaaagtggagaaaggttgatgctatcaggtgatacggcatccaacggggagaggtacaagaaaacattagaagaagcatttctccttatgtcaagctttgcggtttctgacgtattcccatgcttagagtgggtagacagatcaagaggccttgtaaggagcatgaaacgctttggagatcagctaaattcaattgcagggtgtcttattgaggagcatcgccaaaagagatcacaatccgtatcagcatcaaattctacaaatgataaaggagttggtgatgaacaagacttcattgatgttctcttatcggttgctgaactatcacaaattcctggagatgaccctgatttggtcatcaagtctatgattttggaagccttagcaggtgggagtgacacaacaacatcaaccctaacttgggttctttcactgctattgaaccaccccaaagtgttaaagacggcaaaagaggaaatagatatgcacgtcggacgtaatcgatgcgtagaagagtcagatattcccaagctcgtttatgtcaatgcaattatcaaagaatcaatgagattgtatccaaatgggtcattggttgatcgattgacgttggaagagtgtgaagttggtggattccatgtcccagctgagggacacttattcgtaaacgtttggaagatccatagagatccgagtgtgtgggagaatcctctggagttcaagccagagagatttttgagtaatgattgcaaggtggatatggatttcataagtcaaaaatatgaattcataccattcgggataggtcggaggatatgtcctggtatgctttcagcattacaggtgatgcattttgtggtagcccgtcttattcatgggtttgatatggaagcagcaagtgccgatgggaaagtggatatggcagaaaagccaggcatgacttgctataagatgacacctcttgaagttatgctcacggctcgacagtag

SEQ ID NO: 217 - DNA, 1647 bp, Papaver bracteatum
atgtatccggtaaaccagttgcagagtcaagcaattgctgtgctatgtgccgtaattgtcttcatcttctatttggggagaaagttgtttaacagtacccatattcataagcctggaaagacagcaccagaaccagcaggcgcatggccgattataggtcatcttcacctccttgggggagcaaaactcatgtaccgaaccctaggttctttggcggacgaatacggaccagttttcatggttcgacttggtatgcgacgggttcttgtaattagtaacacggcgtcagctagagagtgtttcactacaaatgataaggtttttgctacccgcccaaccacagttgctataaagttgctgacttacaatcacaccatgtttggttttgcaccttatggaccttactggcgcgagatacgcaagatagcaacaacggagctcctatcggatagacgtctagccatgctcaaaaacgtgtggatctctgagattaatttgtgcataaatgaattacatcaactcttgatggacaagaatagtagaaaagtagatcatcatcaacatgtttacaaccaaaatatggacccaatttcggtggagatgaacggatggtttgcagatttgtctttcaatgttgtggccagaatgatagctgggaaaagatatttcggaaagaacaccgatggtggcgaagaagaaaccaggaggtatcgggaagcaatgaatgattttatgcacttggtagtgatattattggtgtctgatgctgttccatttttagggggtttagacttccagggatataagaaaaggatgaagaaaactgccaaggaaattgattattttctgggtaaatgggttgatgaacatcgacagcgtttgaaatataaaaacatatccaaggttgatcaacaagatgatttcattgatgtgttactgctgaatttaaatgatcaaccgatctatggtcgcgatactgatacaatcatcaagtctacttgcctgtctcttatcgcaggtggtagtgacaccacagcagttaccctaacttgggcactatcgttactgctgaacaaccaacacgtgttaagaaaggctcaggacgagttggacatacacgtaggcagggaaagacaactggaagaatcagatatcaagaacctcgtttatctccaggccatagtgaaggaaacattgcgtttatatccagctgcaccgttatcagcaccaaggatggcaatggaagattgtacggttgcgggattccaagttagtaaaggcacacagctgatgcttaatgtatggaaactacatcgagacccgcatttttggggacctgatcctctggagtttaggccagagagatttcttactgctgatggtagtagcacgggaagtggtcattgcattgatattgatgttaagggtcggcattatgagttactaccatttggatctggtagacggatgtgcccaggagtttcatttgccatgcaagtcgttcatctgacgctcgctactttacttcacggatttcatttatcgacgccaacagatggtccagttgatatgactgaaacttcaggacttagttgccccaaagcaaccccattagaagttttgctcactccacgtctgccctgttag

SEQ ID NO: 218 - DNA, 1704 bp, Papaver bracteatum
atggatgtggcaatcatcgtcgatcaccactacttgcagccgttcgtgagtattgcaggcttattagctttgctatccttcttctattgtatttgggtctttattataaggccaaggattatcaaaagcaacttagacgagcgcaaattatcaccatcatctccacctgaagttgcaggtgcatggccgatagtagggcatcttcctcagctaataggatctacacctctattcaagatccttgcggatatgtctaacaagtacggacctattttcatggtcagatttggtatgtatccgaccctagtagtgagcagttgggagatgtcaaaagaatgcttcactaccaacgataggttattcgctactcgtccacctagtgcggccggaaagtacctcactaaagccttgtttgccttttctgtgtatggtccttactggcgggagatccgtaagatctctacaatccatttactctcacttaggcgcctcgagttacttaagcatggacggtacttagagatcgacaaatgcatgaaaagattatttgaatattggatggaacatcataagaacatcataagcacaactagttcagttaaggtcaacatgagccaagtgtttgcagaactatccttaaatgtggttttgaagataatagttggaaagaccctttttattaaaaatggtaatgaagattacaccaaagaggaagaagaaggccaaaagctccacaagactatcctaaaattcatggaactagcgggggtatcagttgcatctgatgttcttccattccttgggtggttggatgtggatgggcaaaagaaacaaatgaagagggtctacaaggagatgaacttgattgcttcaaagtggcttggagaacatcgagagagaaaaagactgcaaataatacaaaaacgcggagcagcaagaggcagtaattatgatgatgggaatgacttcatggatgtgttgatgtcaattcttgatgaagaaaacgatgatctcttctttggttacagtcgagatactgtcatcaaatctacatgtctgcaacttatagtggccgcttcggatacaacgtcacttgcaatgacatgggctctctcactgctgctcaccaatcctaatgtcttacagaaggctcaggatgagcttgataccaaagttggcagggacagaataatagaggaacacgatatcgagtgtctcgtctacctccaagcaattgtcaaggaaacactccgattgtaccctcccgctccactctccctaccccatgaggctatggaagactgcactgttggtgggtaccaagtgaaagcaggcacacgcttagtagttaacctgtggaaactgcagcgtgatcctcgagtgtggtcaaacccgttggagtttaagccagagaggtttcttccacagtcagatggtggttttggtggtgaagaagcaagaatggacttcaggggacaacattttgagtacacgccatttggatcagggagaaggatatgcccaggtatcgactttttcctccagacagttcacatggcactagctcgtcttcttcaggcatttgatttcaacacagctggaggactagttatagacatggtggaaggtccaggtctaaccatgcccaaagtaaccccacttgaagttcacctaaacccacgtctgccggtcacactttactag

SEQ ID NO: 219 - DNA, 1677 bp, Papaver bracteatum
atgcaggtggattggccaaacatcttacagaagtactacccaataataacatgttcattattaactttgctatccttctattatatatgggtctccatcacaaaaccaagcaggaattcaaaaaccaaattaccgccacctgaagttgcaggttcatggcctatagtaggtcatcttccacagctagtaggatctacacctttgttcaaaatccttgctaacatgtctgacaaatatggacctatcttcatggtccggtttggtatgcacccaaccttagttgtgagtagttgggagatgtctaaggaatgcttcaccaccaatgacaagttcctcgccagtcgtccacctagtgcttcagccaagtacctcggttatgataacgccatgtttgttttctcagattatggtccttattggcgtgagatacggaagatctctactctccaattactcacacacaagagactcgattcgctgaagaatatcccttacttagagatcaacagctgcgtgaaaacgttatatacccgttgggcgaaaacccaaagccagataaagcaaaatgttggaggtgcagctgacgattttgttaaagtcgacatgacagaaatgtttggacatctaaacttaaatgtggtgttgaggcttgttgtaggaaagcctatttttatccagaaagacaatgctgatgaagactacacaaaggatggccataacaaagaggaattaggtcaaaagcttcacaagactatcatagagttctttgaattagcaggtgcttcagtcgcatctgatgttcttccatatcttgggtggcttgatgtagatggacaaaagaaacgcatgaagaagatagccatggagatggacttatttgctcaaaaatggcttgaagagcaccgacaaaaaggaatcaatcatgataatgagaatgacttcatggccgtgttgatatcagttcttggtgaaggaaaggatgaccacatcttcggttacagtcgggacactgtcataaaagccacatgtttgacacttatcgtagcggctacagacaccactttagtgtcattgacatgggctctctcactactactcaccaatcctagagtcttaagcaaggcgcaagatgagcttgacacagtagtcggcaaggaacgaaacgtagaagatcgagacgtcaatcacctggtctacctccaagcagtcatcaaggaaactctccggttgtaccctcctagcccactcgccgtaccccatgaggctattgaaaactgtaatgtgggcgggtatgaagtgaaagcaaggacacgtttattggttaacttgtggaaaattcatcgtgatcctagagtatggtcaaacccgttggagtttaagccagaaaggtttctcccaaaactggatggaggtactggtgaagcttctaagttggacttcaaaggtcaagattttgtgtatacaccattcggttcgggacgaaggatgtgcccagggatcaactttgccagtcagacgcttcacatgacgctagctcgcctactccatgcattcgattttgacattgagtcaaatggactagtaatagacatgacggaaggttcaggtttaaccatgcccaaagtaaccccactccaagttcaccttcgcccacgtctccctgccacactttactag

SEQ ID NO: 220 - DNA, 1716 bp, Papaver bracteatum
atgatggatctagcaatgttcatcgatcaatacttctcattagctaaaattgcaggcttattagctttgttatctttcttctattatctatggatctcaactttgtggtcgccaaggaatcccaaactatcatcagtatcaccacctgaagttgctggtgcatggcctatattaggccatcttcctcagctactaggatcaagacctctattcaaaatcctagcagacatgtctgacaattatggtccgatcttcatggtccggtttggtatgcatccgaccttggtggtaagcagttgggagatggctaaagagtgcttcaccaccaacgacaggttcctcgctggccgcccatcgggtgctgccaacaagtacctcacgttcgccctgtttgggttttccacatacggcccttactggcgagagatccgtaagatcgctaccctccatttactctcacataggcgtctcgagcttctcaagcatgttcctgacttggaggtcaccaactgcatgaaacacttgcatcgacgctggatagacagtcaaaaccaaataaaacaaaatgacgctgcagctggttcagtaaaagttgacatgggcagagtatttggcgagctaaccttgaatgtggtgttgaagttagttgctggaaaatcaatttttttcaagaacgacaacactcgtcaatatgactccaaggatggtcataacaaagaggaggaagaaggtaaaaagctccataagaccatcatagatttctactcattagcaggagcttcggttgcatctgatgttcttccatttcttgggtggttggatgtggatggacaaaagaaacgcatgaaaagggtagccaaggatatggatttcatcgctgcaaagtggcttgaagagcaccggcatcaaaaaagacaaacagtactatcaagctcagcaacactaggcagcagtaatcatgacgatgcgaaagatttcatggacgtgttgatgtcaattcttgatggggaaaatgatgatctcttctttggttacagccgtgacactgtaatcaaaaccacatgtctgcaacttatagcagctgccgcagataccacatcagttacgatgacatgggctctcgcactactaattactaatccgaccatattaagaaaggctcaggatgagcttgataccaaagtaggcaaggacagaaacatagaggaacgcgacatcaatgatcttgtctacctccaagcaattgttaaggagacactccggatgtaccctgctggcccactcaacgtaccccacgaggctatcgcagactgcaatattggtgggtatgaagtgagagcaggcacccgtttgttggtaaacctatggaaaatgcaccgcgatcctcgagtatggtcaaatccgtcagagttcaagccagagaggttccttccacaactggatggtggatctggtggtgaggcggcaaacttggacttcaggggtcaagactttgagtatctaccttttagtgcaggaaggaggatgtgtccagggatcgacttttccctccaaacgcttcatatgactcttgcgcgcctgcttcatgggttcgatttcaacaatgactcggcaggaataataatagacatggaggaaggttcaggtttaactatgcccaagttaacaccactagagatttacctctgcccacgccttccagccaaactctactag

SEQ ID NO: 221 - DNA, 1632 bp, Sanguinaria canadensis
atggagtttctttctctacaattccaaccgattaccatttttgcccttcttcttgccactcccatttttctgtacaatctctggaattatggaaggaaactcaacaacaagaacaagaagagcagaaaaccaccagcacctgaagcatcaggtggatggccgatcatgggtcattttcatcttttcaatggaaccgaggtgactcaccgagctctcggttccatggcggacaaatacggtccagctttcaatatccgaatcggttctcatccaacacttgttgtgagtagttgggagatcgctaaggaatgtttcaccacaaacgaccgactcttctcaaataggccaggttctttagcgattaaactcatgttctacgatgccgattcggttggttatgcaccgtacggaacttactggagagagttgagaaagatttcaactctaaaacttctttcaaatcacagattggaaacgcttaaacatttgagaacatctgaagttgaatcctgttttaagcagcttcatgatttgtggcggatgaacaataaaaagggggggagcgatgatggatcagattttgctctggtgaggatagataattggtttggtgatttgacttttaatgttgtggcgagaattgttgccgggaaaaagaattttgcgggaggtgcggcgagtggtgatgccggagctcaaagatataaggaagccatggatgaagcgtttcgtttgatgacgaggtttgcgttctcagatgttgttccatcgcttggatggttagataaattgacaggacttgttggaggaatgaaacgttgtggatctgaaattgattcgatcgttgcaagttgggtggatgaacatcggttgaaaagaatttctggaaaagaaggggatgatcttgaacaggatttcatcgatgtttgcttagagattttggagcattctactttgcctggcgatgatcctgaagttgtcatcaaatctacttgcctggacatgatattgggtgggagtgacaccacaacagtgaccctaacatgggccctctccttactattggaccatccccacgtgtggaaaagggcgaaggaggaagtggatgcacacgtgggaaaggagagacaggtggaggactcagatatccctaatcttgtgttcatccaagcaatcgtcaaagagacgatgagattgtacccagctggaccactgatcgagcggaggacaatggatgattgtgaggtaggtgggttccacataccaggtggcacacgtttaattgtgaatttatggaagattcaaagagacgggagcgtgtacaaggaggatccattggagtttagaccagagaggttcctgacgagcaacgcggaggtggatctaaagggacagaattacgaactgataccatttggtgctggaaggaggatatgtcctggagtgtcgttcgcagtgcaattgatgcatttggtactggctcgtctcattcacgacttcgaaataacgatgcccatgggtgcgaaagtagacatgactgagagtggaggactaatcagccacaaggtgacgccgctggaagtgctgctcaaaccacgcctcccctcgctccaacaagcagctttatattaa

SEQ ID NO: 222 - DNA, 1578 bp, Sanguinaria canadensis
atggaatattcctcagtacttctccattggttccctgcttccatggctgcccttcttgccttggtttttctgtacaatctcatctttaattccccaaaaaccggtaataagaagattataaggagggcacccaaagcagccggtgcatggccagtccttggtcacctccatttgtttggatcaggtgagctgcctcacaaaatgctcgcagccatggcagaaaaatacggccccgccttcacaatgaaattcggtaagcacacgacactagttgtgagtgacacccgcgtcgtaaaagaatgtttcaccaccaatgacaccctctttgccaaccgtccatccaccaaagcctttgatctcatgacttacgccaacgactcggtagccttcacaccttacagtccttattggcgcgagcttagaaagatatccactctcaaacttctctctaaccaccgcctccaatcgatcaaggaagtccgagtctccgaggtgagcgtatgttttagggagctatacgatatatgcaaaaatgatggaggaggagctcctccagttttggtggatatgaagaaatggttcgaagaggtctcgaacaacatagtgatgagggtaatcgtagggaaacaaaattttgggtcgaagattgtttgtggcgaagaggaagccgtcaattacaagaacgtcatggatgagctcctacgtcttgctagtgtgtctatgttatcggatgtggcacctttacttggttggttggatatgttccaaggacacatgagcgccatgagacgaaatgggaaaaaactagacaccatacttgagaggtggttggaggagcatcggaagaagaagagtgaggatgagcaagatttcatggatgttatgttgtcgatcgttgaggagactaagttgtctggccgcgacgctgataccgtcattaaagctacttgtctggccatgatcatgggtgggacagacaccacggctgtgagtctaacatggatcgtttccttattgatgaacaatcgctatgcattgaaaaaggctcgagaagaattggacgcgctcgtggggaaagatagacaagttgaagattcagatttgaagaatttggtgtacttgaatgccgtcgtcaaggaaacgatgcgattatacccgttgggtactcttcttgaacgtgacaccaaagaagattgtgaggttggtgggttccatgtggaaggcggtacgcgtttactagtgaatgtatggaagttacaacgagacccaaacgtgtggaatgatccattagaatttagaccagagagatttctaacagagaatgcggatatagatgtcggaggccaacatttcgaattactaccatttggggcagggagaagggtgtgcccaggagtgtcgttcgcactccaattcatgcatttggtattggctcgtctcatccatggctatgaattgggaacccaaaatgatgaggatgtggatctaactgagagcacagaaggacatgttaaccacaaagcctccccgctcgatctcctcatcaccccacgcctccaccctaaactttatgaataa

SEQ ID NO: 223 - DNA, 1584 bp, Sanguinaria canadensis
atggattattcatcccatttgaaccagttctacggggtagctccatacatggctgccctactaattgccttagtgtttctctacaatattctttgggcttccccaaaaaccaccaacaagaaaccaatcatggcagccggggcatggccaattctaggccacctccatctgtttaaagatggggaattgcctcaccacatgcttaaatccatgtctgataaatacggccctgccttcctcatgaagttcggccaacaccgaacactcgttgtgagcaactaccgcatggtaaaagaatgtttcactactaatgacacccacttttgcaaccgtccatccaccacagccttcgatgtcatgacttacgctaatgactccgtcgctttcacagcttacagcccttactggcgtgagcttagaaagatttccactctcaaacttctctctaacaaccgtctccaggccatcaagaacctccgagaagccgaggtgaacgtatctttcagggggttgtatgatttatggaagaataatagtgatcgagctgcgtcggttttggtcgatatgaagaaatggtttgaagaggtctcaaacaacgtcgtgattagggtgatcgtggggaaacataattttgggactaagattgtgaagggtgagaaggaggctgtggaatacaagacgatcatggatgagctcttacgtcttgctagtttgtctttgttatctgattttgctcctatacttggttgggtggacttctttcaaggaaacgttcgaaaaatgaaacgaaatggcaagaaactagacgtggtacttcagaggtggttggagacgcatcggaggaagaagaactcaccagaggatgaacaagacttcatggatgttatgttgtcgatcgttgaggagggcgacaagttgtctggccaccacgctgatactgtcattaaagctacttgcttggccatgataatgggtgggacagacacgtccgcagtgagtctaacatggatcgtctccttactgatgaacaatcgtcatgcattgaaaaaggctcgtgaagaattggatatgtacgttgggaaggataggcaagtagaggattcagatttaaaggacttggtttacttgcatgcaatcgttaaagaaaccatgcgactgtacccactgggtactcttcttgaacgcgagaccaaagaagattgtaaggttggtgggttccacgtcgaagccggtacgcgtttactagtgaacatatggatggtacaacgagacccaaccgtgtggagtgatccaacaaaatttataccagagaggtttctaacagagaaggcggacatagatgttgggggtcagcatttcgaactcataccattcggggccggtagacgggtgtgccctgccgtgtcctttgcactccaatttcttcacttgatactggctcgtctcatccatggatatgaattaggaaccccaaatgacgcggatgtcgacttaaccgagagcccggaaggacatgttaaccacaaagcatcccctctcgaactcctcctcaccccacgcctcgaccctaagctctatatatga

SEQ ID NO: 224 - DNA, 1608 bp, Sanguinaria canadensis
atgaattcaatcgcagtcgtcggtgttcttcttttcttcctctactatctatggaggacactattcaccactcacaaagcggcgccaccaccacaaccagccggagcaaggcctattataggtcacctacatctcctcggtggagcgaatcaactagtccatcaaacactcggttccatggcagacaagtacggatcaattttcatgatccgactcgggatgcgacgagtcctcgtggtgagtagctccgagttagctaaagaatgtttcactacgaacgacaaggttttcctcaaccgcccaagttcattagctttaaagctgatggcctacaacaacgccatctttggttttgcaccttttggtccttactggcgtaagatgcgcaagatagcagtcaccgaacttctatccaacagacgcctcgagatactaaaaaacatcaggatctccgagatcaacatgtctataaaagaattacatcaactatgggtagatatgaacagtggtgatgatcaagtggggggcccaccaattgtggtggaaatgagaaagtggtttggggatttatcgttcaacgtggtgggtagaatgatagctgggaaaagatattttgggaggaattgtgattgtgatgaagaagaaacgaggaggtatcagaaggcgatgggtgattttatgcatttagtgggggtttttgtggtgtcggatgcgattccgttattagggtttttggatttacagggatatgagaagaagatgaaaaggacggccatggacattgattgtgttttagggagatgggttgatgaacatcgacgacgacgacaagaccacgatgagaagaggattatggtctccgatgatgatcatcaaggacaagatttcattgatgtgatgctatcgatcttaaatgatgatgatcagttctacggttacgatgctgatacagttatcaagtctacctgcctgtctcttatcgcaggcggccacgagaccacggcggtcacactaacatgggccctctctttactactaaacaatcgacacgtgttacaaaacgcgcaagatgagttggacatccacatcagcaaggaaagacaagtggacgaatcagatatcaagaacctgaaatacctccaagccatagtcaaggaagcattgcgtttatacccagctttaccactttcagcactaagattggccatggaggactgcaccatagctggatttcatgtccctaaaggcacagaattgatgcttaatctatggaaattacatcgagaccctcacgtttggtctgaccctttggagttcaagccagaaaggtttcttactaatagcacccatgaagaagttgacgttgggggtcaacattacgaattactaccatttgggtctggtagacggatgtgccctggggtatcgtttgctcttcaagtcctgcacttgacgcttgctcgtctacttcatggatttcatttgtcgactccgtccggtgtacctgtggatatgactcaaagttttggccttagttgcccaaaagcaactcccttggatgtcctccttacaccacgtctcccttcaaagctatattatgtagcataa

SEQ ID NO: 225 - DNA, 1806 bp, Sanguinaria canadensis
atgatttcaactacgccggacgtactagctacctcatcatattcatcatctaacaagcatatggattcagatcatctttaccggttctcaactagtactagtatagttattggcctctttattttactattcttccttgtgctcctatggaaaccaaagaagcagtctgctacttctaagactaacaaaccaactagagagcagcgggcaccggaaccttctagttcatggcccataatcggtcatctccgtctcttcggaggaccaaatagccttccccacataacattgggagctatggctgataagtatggaccagtcttcaccatccgaatgggttcgcgtccagtgcttgttgtgagtagttgggagacggcgaaagaatgtttcaccaccaacgacagggtcttcgcctctcgtccacgcactatagccattaaacatatgtgttatgaacatgtcatgcttgggttcgccccttacggatcatactggcgggaattgcgcaagatagtgaaccgagagcttctttcgaataatcggctagagttgttaaaacatgtatggggatctgagattaacacatccattaaagaactgtatgagttgtggttggtgaacaaaaacaacattgaagcagaaggtgaaaatgaaggtacaagtgatagggttttggtggagatggagagatggtttgcggatttgactctaaacatgtctattaagattgttgttgggaagcgatacccctccggtgttactgccggtggtagttctggttgtgatgatgatgaagctcagaggtgccggaaggccctgagagatttctttaagctggtgggtctgtttttggtgtcggatgcgatcccctttctaaggtggttggacttgggtggttatgaaagagagatgaagactactgcaagagagttggactgtttaatggaggaatggttggaagaacataaaatgaagaggagattattaatttcaccgtcggcaggtgatcatcatgaagctgcagagatcatgatcaataagcagaaggaagcagagctacaggaatatgacttcatggacgtgatgctatccatacttgatgacgatattgagggtaaaaacctttcagattacgacgtcaatgccgacactatcaacaagtctacttgcctgaatctaatcctaggtgggagcgacacaacaatggttactttaacatgggccctcgctttactactaaataatccacacgtgttacaaaaggcccaagatgagttggatatccacgtaggcagcaagagacaagtggacgattcagatatgaagaacctcatatacctccaagctatagttaaggaaacaatgcgcctatacccagcaggtccactatcagtaccacacgaatcaactgaagactgcaccgtagctggctaccacgtccctgcagggacccgtcttattgtaaatacctggaagatccaacgtgacccacgggtatggtccaacccatcagaattcaaaccagagagatttctcacagacagtcacgtggacatagatgttagaggtcggaattttgaattgatcccttttgggtcgggcaggaggtcgtgcccgggtacctcatttgcactccaagtggtgcacctggtactggcccgtttgatacatgggttcgagtttaaaacaccgtcggaagcacccattgatatgacggagagcgtaggcctaagtaattttaaagccaccccacttgatgttctgctcaccccacgtctcccttctcagctttattatgtttcttag

SEQ ID NO: 226 - DNA, 1578 bp, Sanguinaria canadensis
atggattctactttggttttcattggcctctttgctttactactagtctaccccttactactaagaagatcagtattgaagtctacttcaaatactaataagactacttataaatcgaaaaaccaagcaccggaggcggccggggcgtggccgataatcggtaatcttcatcaactcgcgggtggaggaaactgtctccataaaacgttgggagccatggctgacaagcacggaccggctttcaccatccggatgggtctacataaagcacttgtggtgagtagttgggagctagcgaaagagtgtttcactaccaacgacgtggttttcatgtcccggccgcatcaagtagccattaaacacatgggttacagcaccgccatgtttggaatcgctccttatggcccatactatcgcgaaatgagaaagatagtgactcaagagcttctctctaaccgccgcctagagttgctaaaacatgtatgggcctctgaaatcaacaactccattaaacaactctacgagaaagtcgaaggcggaccagttttgatcgaaatgaagcgatggtttgcggatttaacgctaagaacgacggttaaggtgatttgtggacagcaacaatttggaggagatgatgatgatgatgaagctggaaggtttcaaacggcgctgagagacttctttaggttgttaggtcactttcgagtggcggatgtgatacctgttctagagtggctcgattttcagggatacaagaaagagatggagaataatggaagagtgcttgataatttaatgaataaatggttggaagaacataaaaggaagaggaagaacggtggcaccgaagaggacttcatgaacgtgatgatatccaaactgcttgatgatacaaagatgctttcctattacgacgccgatactatcaacaaatctacttgcctgacactaatcctgggtgggagtgacacaaccatggttagtttaacgtgggccctttctttactagtgaatcatccacatgtgttgaaaaaggcccaagaagagttggatgtccacgtaggcaaagaaagacaggtagacgattcagatctctggagcctcacataccttcaggctattatcaaggaaacattgcgactatacccacctggtccactctcagctccacgcgaatcaacggacaactgcaccatagctggctaccacgtccctgcaggaacccgtctaatagtgaatacctggaagattcaacgtgacccacgggtatggcccgacccattagagttcaagccagagagatttctcaccacccatgtggacgtggacgttaaaggtcagaatttcgaactcctaccattcgggtcgggtagaagagcatgcccaggtgcctcattcgcgcttcgggtgctgcgcctgtcactggctcgtttgatacatgggttcgactttaaaacaccattggacgactcacccattgatatggtggagagtggaggaataactaatgttaaagacaccccacttgaagtactagtcaccccacgcctcccttctagtctttatgtttgcaaatag

SEQ ID NO: 227 - DNA, 1599 bp, Sanguinaria canadensis
atggattttgatctttaccaattctcaaaacctactatcttcattggaggcctctttgctatacttctctactttgtactcaaaaaatctagtactcccaaatccaaatcaaaattagaacaaccacccgaaccggctggcgcgtggccgatcatcggtcatcttcctctcctcggaggacccgatctccctcacataacattaggaaaattggctgataaatatggaccagccttcaccatccgaatcggtgttcataaagcggtggttattaatagttgggaggtggcgaaagagtgtttcaccaccaacgacaaggcgttttcttcccgtccgcgtcaagtagccatgaaacacatgggttacgattacgccatgtttgggttcgccccttacggaaattactggcgtgaactccgtaaaattgtgaaccgagaggttctgtctcatagtcggatcgagtctttatatcacgtatggggtactgagatcaacacgtccgttaaagaactgtacgagttgtgggggaagaaaagcaccggcagcggcggtgcaccggtcttggtggaaatgaaacgatggttctccgacatgacactcaacatgtctgttatgatggttgcaggtaagagatacaactttagtggcaacaaagctgacgatgaagctgggaggtgccaagatgggctgaggaacttctttcggttagtcggtctgttcgtgccatccgacgcgttgccgtttttggcgtggttggacattggtgggtacgagaaagaaatgaagaaagtagcgaaagagcttgatgttttagtgcaggaatggttggaagaacacaaagagaagaggttggcattgacggccgcggggaagaaaggaagcgaaaacgatttcatggacgtgatgatgaatatacttgaagatcaaaaactatcagaattcgatgcagatactatcaacaaggctacttgtctgactttaatcctcggtggaaccgatacaaatatggttaacttagtgtgggccctgactttactggttaacaatcaagatgcgttgaagaaagctcatgatgagttggacttccacgtaggcaaagatagacaagttgaagaatcagatgtaaagaacctcgtgtacatccaggctataatgaaggaaacactgcgtctatactcgggcccactgtcgggcttacgcgaatctacggaggactgcaccgtagctggttactacgtcccagcagggacccgtttgattattaatgcagcgaagattcatcgtgacccacgggtatggtctgacccaacagctttcaaaccggatagattcctcacggaacagaaagaaatggatgttagaggtcaggatttcgaaatccttccattcggggcgggtagaagaatatgcccgggtgtgtcattcgcacttcaagtattgccattggcactggctcgattaatacatgggttcgactttaaaacacccacggatgcacccattgatatgacagaaagtccaggactaactaatgctaaatccaccccactcgaagttctagtctcaccccgcctcacttctaaactttatggttgttaa

SEQ ID NO: 228 - DNA, 1668 bp, Sanguinaria canadensis
atggattctattctaaaccagttcatctcaaaacctactatggttatttgcagcctctttgctttactatccctctactttctactgatcaaaaggtctaccactaaatcaaaattacaactgccacccgagccggcgggtgcgtggcctgtcatcggtcatctccatcagttgggtggacctaacttaccccacataacattagcagccatggctgataagtatggaccaatcttcaccatgaaaattggtacgtatcgagcactcgtagtgagtagtccggaggtagcgaaagagattttcaccacccacgataggatatgggcaacccgaccaaatcaagcagccatgaaacacttgggttacgactcggccatgtttgggttcgcaccttatggaccatactggcgtgaacttcgcaagttagtgaaccgagaacttctctctaatactcggctcgatttgctacatcatgtgtgggattctgagattaacacttccattaaagaactgtacgattcgttagcgaccaaaaacaatgcaaaaggccgtggtactggcggcgccggtagtactggtcctgttttggtggaaatgaaacggtggttcgcggatttgacgctaaacataactgttaggatggttgctgggaaacgatactttggtgctaataaaacttctagtactagtactgatcaatgtgataatgaaaaaggagatagtaaagcatggaagtgccaaagggagctgagaaacttctttaggttggtaggtctgtttgtagtgtcggacgcgttaccgtttcttgggtggttggatttgggtggtcacgagagagagatgaagaatactgcaagagagttggatgttttagttcaaggatggttggatgaacataagaggaagagatcattatccgtggctgaaggcggggagaagatcaacggcgaacaggacttcatggacatgatgctgtccacaatcgacgacgctaagttatctggttatttcgacgctgatactatcaacaagtctacttgtctgaatctaatcctgggtgggagtgacacaatgatggttaatctaatttggcccctcacgttactggtgaactatccagacgagttgaagaaggtttatgatgagctggacacccacgtaggcagagatagacaagtggacgaatcagatatcaagaatctcgtgcacctcaaggctgtaatcaaggaaacaatgcgtctatacacgggtcggatcacaggcctccgccaatcatcagaggattgtaccgtggcagggtaccacgtaccagcaggtacccgcctgattgtaaacacgtggaagattagccgagacccacggtactggtccgacccgttagagttcaagccagagagatttctcacgacccatgcggatatcgagcttacaggtcagaattttgaactaatcccgtttgggtcgggcagaagatcatgcccgggtgcctcatttgcaattcaattgctgcacctggcactggctcgtctggtacatgggttctggtttgaaaggccgtcggatgcacccattgatacatcagagtgtcctggactaactaattttaaagccaccccacttgaagttctggccaccccacgcctcccttctaaactctatgttggttaa

SEQ ID NO: 229 - DNA, 1617 bp, Sanguinaria canadensis
atggattttattctgaaccagttcatctcaaaacctactatggttcttggcaccctctttgcattactatccctctactttctactgatcaaaaggtctaccactaaatcaaaattacaactaccacccgaaccggctggtgcgttgcccatcatcggtcatctccatctcctcggtggaccaaacccgccccatataacattagcaaacatggctgagaagtacggaccgatcttcagtatcaagatgggtttaaaacgagcactcatagtgagtagttcggaagtaaccaaggagtgtttcactacccatgacttgaatttcgtctctcgaccacgtcatgcggctatgaaactcatgggttataatttcgctacgtttgggttcgcgccttatggaccttattggcgcgaacttcgtatgataattaaccgagaacttctctctcaaactcggatcttgtcgttagaacatgtatggggttctgagatcaatgaatccattaaggaactgtatgatttgttgacgagaaaaggtggtggtggtggtggtccggtggtggtggaaatgaagcgatggtttgcggatttgaccttaaatatagccgttaagatggtgtgtgggaagcgatacttcggtgttaattctcctagcactagtacgactcgtgatgttcaagaagatgatgaagctcggaggtgccaaaaggggatgagaaatttctttaggttgcttggtcagtttgtggtgtccgactcgataccgtttctggggtggttggatttgggtggttaccagagggagatgaagaataccgccagagagctcgacgatttaatgcagggatggctggaagaacataagaagaagagattggaaaggaagacggccgcaggggaacaagacttcatggacgtgatgctgaacatacttgaagatggaaagctatctcaatatttcgacactgatactatcaacaagtctacttgcctgagtctaatcctgggcgggagtgacacaacgatggttaatttagtgtgggccttcagtttactggtgaaacatcaagatgcgttgaagaaaactcgtgatgagttggacatccacgtaggcagagaaagacaagtggaggaatcagatatcaagaatctggtattcctccaggctgtagtcaaggaaacatttcgtctatacgctggcccaatctcaggagtacgggaagcagcggaggactgcaccatagcaggctaccacgtcccagcagggacccgtctacttataaatagctggaagattcaccgtgacccacgggtatggtccgacccattagagttccacccagaaagatatctcgaggcgaggcatgcggacattgacgttaaaggtcagaatttcgaactcgccccattcggaatgggtcgaagagtttgcccgggttccgcatttggactgcaagtattgcacctgacactggcccgtttgatacatgggttcgagtttaaaacaccgtcagacgcacccgtggatatgacggagagtgtaggaatgagtattattaaagccaccccacttgaagttctcgtcacaccacgcctcccttctgaactatacgtctaa

SEQ ID NO: 230 - DNA, 1602 bp, Sanguinaria canadensis
atggatatttctaatctttacgagttatactatttctccacacctactctgtttgtcggaggcctctttgttttattactcatctactctctattctcatccaggcctggaattaaatcaaaattacaacagccacctgaaccggccggtgcatggcctctcatcggtcatcttcctgtcttaagtggaccggaactaccccatgtcgcattgggaaagttggctgacaagtacggaccagtcttcaccattcgtatgggtgttcataaatcacttgttgttagtgattgggaggtaattaaagagtgtttcactacccacgacaaggtcttctcgtctcgtccttgtcaagttgctatgaaactcatgggtacggccatgtttggcttctccccttacggaaattattggcgtgaacttcgcaagatcatgaacagagaggttctatctcatggtcggatcgaatctctttaccatgtatggggttctgagatcaatacgtccgttaaagaactttacgatttgtgggcgaagaaaaacaatggtggtggtccaattttggtggaaatgaagcgatggttctccgatttaacgcttaacatgtcggttatgatggccgctggaaagcgatataattttggtgatgattcttctactactaatgatgaagcggcgaggtgccaacatgcgctgagagagttttttaggttggtgggtttgtttgtgccatcggacgccttaccgtatcttgggtggttggacataggtgggtaccaaaaacaaatgaagaaagtagcaagagaattggatgatttaatgcaggtatggttggatgaacataaaaagaagaggttagcagcgaaagccgaagggaagaagggaggcgaacaagacttcatggacgtgatgatgactatacttgaggacggaaagctatctgattattacgacgctgatactatcaacaaggctacttgcttgactctaatcctgggtgggaccgacacaaacatgcttagtttagtgtggaccctggctttactgatgaataatcgacaagccttaaagaaggttcatgaagagttggatatccacgtaggcagggaaagacaagtggaagaatcagatatcaagaacctcgtatacctccaggctgtaatcaaggaagaaatgcgtctatactcgggcccactttcaggtctacgcgaaacaacggaggactgcaccatagctgggtaccacatcccagcggggacccgtttgattataaatgcatcgaagctccaccgtgatcctaaggtatggtccgacccgttagagttcaagccagagagatttcttacggaaaacgtgggcgtggatgttagaggtcagaatttggaactccaaccattcggggcgggtagaagaatctgcccgggtgtctcatttgcacttcaagttttgcccctgacgttggcccgtttgatacatgggttcgagttgaatacacctggggatgcacccattgatatgacggagtctccaggactacaaaatgctaaactcaccccacttgaagttttaatcacaccccgactcccttctaaactatatgtttaa

SEQ ID NO: 231 - DNA, 1608 bp, Sanguinaria canadensis
atgattgttattggcgccttccttgctttagtggtactagtggtctactataatctactactaagaaggccagcattattgaaatttaaaaacatgaagcagcaggcaccagaagcggccagtgcgtggccaataattggtcatctccataatctcgcgggtggcataggcggaaacggcctactccacgaaaagttgggagcaatggctgacaagcacggaccggctttcatcattcgcttggggctgcataaagcactggtggttagtagttgggaggtagtgaaagagtgtttcactacaaacgacgttgccctcatttcccgcccgcatcaagtagcttctaaacacatgggttacggcatggccatgtttgcgttcgcctcgccttatggaccatactggcgcgaattgcgtaagattgtgaagcaagaacttctctctaatagccggcttgagttgctaaaacatgtatgggcgtccgagatcaacacctctattaaacaactctacgagaaagttaaagaaggtggtggtttgccggttttggttgaaatgaagggatggttcgcggatttaaccctaaaaatgacggtaaaggtgatttgtgggaagcgacactttcgagttgcgggtaatgtaggagatcatgttgatgctgatgacgatgatgaagtaattggtgggcgatttgaaaaggcgctgagagacttttttaggttgttaggagatattcgagtggtggacgtgttaccgtttcttcggtggttggattttggcgttggttataagaaagagatggagaataatggaagagtgctggatattttaatggaggaatggttgcaagaacataaaaggaagaggatgaacggcggcaccgaagaggacttcatgaacgtgatgatatccaaattacttaatgatacaaagctgctttcctattacgatgctgatactatcaacaaatctacttgcctgactttaatcctgggtgccagcgacacaactatggttactttaacgtgggccctctctttactagtgaatcatccacaagtgctaaaaagggcccaggacgagttggatgtccacgtaggcagggaaagacaggtggaagattcagatatccagaacctcacataccttcaggctataatcaaggaaacattgcgaatatgcccaccgggtccgattcaagctccacacgaagccaaggacgactgcaccgtagctggctaccacgtccctgcagggacccgtcttatagtaaatacctggaagatccaacgtgacccacgggtatggcccaacccgtcagagttcaagccagagagatttctcacgacccatgtgggcgtggacgttagaggtcataatttcgaactcatacctttcgggtcgggtagaagatcgtgcccagggacctcgttcgcactccaagttgtgcatctgacactggctcgtttcatacatggatttgagtttaaaacaccgtcggacgcacccattgatatgacggagagtggacgaataactaatgttaaagccaccccacttgaagttctagtcaccccacgcatcccgccgtctggtctttatgtttaa

SEQ ID NO: 232 - DNA, 1719 bp, Sanguinaria canadensis
atggatttgctgatcttctccagccagttgcaaggtactgtggggttattagctttactaaccttttcctattatgtatggattttaattataaagaggatcaaaacaaccaacaccttgaaggtcatgaataaagtggcggccgcggcggcaccggaagttgccggtgcatggcccatagtgggtcatcttcctcagctagttggccctcaacagctttacaggattcttggagacatggccgacgagtatggaccgatcttcatggtccggtttgggatgtacccaactctggttgtgagcagttgggagatgataaaggagtgcttcactaccaacgacaggttcctcgctagtcgtccctctagtgctgctgggaagtacctcacttacgacttcgctatgttcggcttctccttttatggtccctattggcgtgagatccgtaagatctctactctcgaactactctcccatcgacgccttgagttgtttaagaacgtccctttcactgagatcgacacctgcatcaaaagattgtaccaactttggcgggttaaaaataatgatcatccagctgctgctccggtaattaaggtcgacatgagccaattgttgagagatctaaccttaaatacaatattgaagttggtggtaggaaagaatttattcaacgagaaggatcatggtgaacaggaagagggtcgaaagctccacctccacaagacgatagttgaattctttaaactggcaggggtttcagttgcatcggatgctcttccgttcctagggtggctggatctggatggacagaagaaaaagatgaagaggatagccaaggaaatagacttaatcgctgaaagatggcttcaagagcatcaagagaagaaatcactatcaaacaagaagctgctggctgctggcggcggcaaagtagacggtcatgacgacttcatggacgtgttgttattcattcttgacgatgattcccagttcttcaatttcagtcgcgacactgtcattaaagccacctcttgggcaatgatcctaacagccgcggacaccacatccgtgtctatgacatgggctctgacgctactactcaccaatccccgtgtcttaagaaaggcccaagatgagctggatatgaaagtcggcagagacagacacgtggaagaacgagatatcgagaacctgatctacctccaagccatcgtcaaggaaacattgcgtttgtacccggctgctccacttggagtacctcacgaggctatccaagactgcaccgtagctgggtatcaggtaagagcaggcacacgtgtgttagtgaacctatggaagctgcatcgcgacccacgtgtgtggtcgaacccatccgaattcaggccggagaggtttctaatcgacgatattgacgagcaaggtggtggtggtggtggtggtggcggtgaatcaacagctaaggatttcagaggtcaacattttgagtacataccatttgggtcaggacgaaggatgtgtcccgggatcaacttcgcccttcagatcgttcacatgacactggcacgcctacttcatgcattcgagttgaggactactacgtccgcatcactaatggacatgaccgaagaatcaggcctcaccatgcccaagaaaaccccacttgtagtcctcctccaaccacgcctccctcttccactttatgatcaccatgagtga

SEQ ID NO: 233 - DNA, 1602 bp, Stylophorum diphyllum
atggagtttctctctctacaacaccaactaatttccatttttgctcttcttcttgcttccatattcctctacaatctcttgaagaatcatggaaggaaatccaagacctcaaaaccaccagcacctgaagcatcaggtggatggccaatcatgggtcatctcaatctcttcaatggaagcgaattaactcaccaagctctaggttccatggctgacaaatacggtccagctttcaatatccgattcggttctcatcaaacactcgttgtcagtagctcggagattgttaaagaatgtttcactacaaacgatcgattcttttcaaatcggccgggatcgttagcgattaaactcatgttctacaacgctgattcagttggttacgcaccgtacggtgcttattggagagatctcagaaaaatctcaaccttaaaactcctttcgaatcatcgactggaaaccctaaaacatttgagaacttctgaagttgagtcctgttttaaacaactttataatcaatggaagaacaacaaagttggcggcgaccatgattttgctctggtgaggatggataattggtttggagacttgacatttaacgttgtggcaagaattgtcgctggaaaaaagaattttgctggaggtgcgacgaatggcgacgtcggagctcagagatataaggaagctatggatgaagcgttccggttgatgacgatttttgcgttctcagatgtggttccgtctttgggatggttggataaattgagaggtttggttggagggatgaagcgttgtggtgcggaaattgattccattgttgcgggttgggtggatgaacatagattgaagagagcttctggaaagggaggaggtcatactgatcttgaacaagattttattgatgtttgcttggagattatggaacattctactttgcctggtgatgatcctgaaattgtcatcaaatctacttgtctggacatgattttgggtgggagtgacacaacaacggtgaccctaacatgggcactctccttactattgaacaatcctcacgtgttgaaaagggctagggaggaattggatacacatgtgggaaaggacagacaagtagacgactccgatatgtctaatcttgtgtacatccaggcgatcatcaaagagacgatgagattgtacccagcaggaccactgatcgagcgaaggacatcggaggattgtgaggtaggtgggttccatgtaccggcgggcacacgcttattggtgaacttatggaagatgcaacgagatgggagtgtgtataaggaggatccattagagtttagaccagagagattcttgactagcaatgctgatgttgatctaaagggacagaattatgaactgataccatttggtgcgggtaggaggatatgtcccggtgtgtcgtttgcggtgcagttaatgcatttggtgctggctcgtctcgttcatggctttgaaatgaagacggccggagatgcgaaggttgacatgacagaaagtgcaggactaattagccacaaggttacaccgctagaagtgctgctcaaaccatgccttgcgattcaacaagctttataa

SEQ ID NO: 234 - DNA, 1602 bp, Stylophorum diphyllum
atggattcttttcttctaatccagtggtttgcagcttccatggctgctctacttgcttttgtttttctctacaatcttgtctggagttcttcaagaactacaaagggtaagaatattagaaaggcacccatggcggccggtgcatggccgattcttggtcacctacatctgtttggatccggtgagctgcctcacaaaatgctctctaccatggctgagaagtacggtcccgctttcaccatgaagtttggtaagcacacaacactagttgtgagtgacacccgtatcgtaaaagaatgttttactacccacgataccctctttgctaaccgtccttcgactactgcatttgatctcatgacttatgctaatgactcggtagccttcacaccttatggtccttattggagggaacttaggaagatatccaccctcaagcttctctctaaccaccgcctccaatctatcaaggaaattcgagtatcagaggtgaacgtatgttttagggagctatatgaatcatgcaagagtaaaactgatgcaactccggttttggtggatatgaagaaatggttcgaagaggtctcgaacaacatagtcatgagggtaatagtggggagacagaattttggttctaagattgtgcaaggcgaagacgaggccgtcaattacaagaaagtaatggatgaactcttacgtctcgctagtttgtctatgttatccgatgtggcccctgtacttggctggttggatatgttccaaggaaacaagagcgccatgaaacgaaatgccaaaaaagtagacaccatacttgagggctggttggaggagcataggatgaagaagagcgcatcaggaatctcttctgctggtgagaatgaccaggacttcatggatgttatgttgtccatcattgaggagaccaagttgtctggccgcgatgcggataccgttattaaagctacttgcttggccatgatcatgggtggtacagacaccactgccgtgagtctaacatggattgtctctttactaatgaaccatcgccatgtactgaagaaggcccgagaagaattggacgccctcgttggtaaggatagacaagttgaagattcagatttgaagaacttggtatacatgaatgccatagtcaaagaaacgatgcgaatgtacccactgggtgctatgctcgagcgagaaaccaaggaggattgtgaggttggtgggttccaagtccaaggcggcacacgattactagtgaatgtgtggaagctacaacgagacccaaacgtttggaccgatccaacagaattcaaaccagagagatttctaaacgaaaatgcggatatagacgttgggggtcaacatttcgagctactaccatttggagctggtaggagggcgtgcccgggtgtgtcgttcgcactccaattcatgcatttggtactggctcgtctcatccatggatatgaattgggaactcagaatgatgcggacgttgacttaactgagagcacagaaggacatgttaaccacaaagcttcccctctcgatctcctccttaccccacgcctcaacaaccctaatctgtatgattattag

SEQ ID NO: 235 - DNA, 1707 bp, Stylophorum diphyllum
atgactataggggctctagctttactatctttcatctattttttacgggtttcagttattaagaggaccaaatacaccaacaccgcggtcaccgccaccaacaagttggaaaatgatgaagatgaggccaatcatagtaagcgagtggttgcaccacccgaagtcgccggtgcatggccaatattgggtcatcttcctcagctagtgggactaaagcagccactgttcagggtactaggagacatggccgacaagtatggacctatcttcattgtccgatttgggatgtaccctaccctagttgtgagcagttgggagatggcaaaggagtgcttcaccaccaacgacagggtcctcgctagtcgtccagctagtgcttctggcaagtacctcacctacaattatgccatgttcggcttcactaatggcccttattggcgtgagatccgtaagatctctatgctcgaactgctatcccatcgtcgcgtagagttgctcaagcacgtaccttccactgagattgacagctctatcaaacagttgtaccatctttgggtggaaaaccaaaaccaaaataagcaaggggatcatcaggtaaaggttgacatgagccaactactcagagatctgaccttgaatatagtattgaagttggtggtaggaaagcgtcttttcaacaacaacgacatggatcatgaacaggatgaagcagctcgtaagctccagaagacaatggttgaactcattaaagtggcaggggcttcagttgcatcggatgcccttccattccttggttggttggatgtagatggactaaagagaaccatgaagaggatagccaaggaaatagatgtaatcgctgaaagatggcttcaagagcatcgacaaaaaaaactaacatcaaacgacaagggtggcagcaacaacattcaaggtggcggtggcgataacgacttcatggacgtgatgctatccatccttgacgatgattccaatttcttcatcaattacaaccgcgatactgtcattaaagccacctctctgacaatgatattagcaggttcggacaccacaactctgtccttgacatgggctctaacgctattagccaccaaccccggtgccttgagaaaggctcaagatgaacttgatactaaggtgggcagggatagacaagtagatgagcgagacatcaagaacctggtctacctccaagccattgtcaaggaaacactacggatgtacccagctgctccactagcaataccccacgaggctacccaagattgtattgttggcgggtatcacgtaacagcaggcacacgtgtgtgggtgaatctgtggaagttgcaacgggatccacacgcgtggccaaacccatcggagttcaggccagagaggtttctagccgttgagaacgattgcaagcaacagggtacttgtgatggtgaagcagcaaacatggatttcagaggtcaacactttgagtacatgccttttgggtcaggaagacggatgtgtccaggaatcaactttgcgatccagatcattcacatgacactggcacggctacttcattcattcgagttgcgggtgccagaagaagaagtaatcgacatggctgaagattcaggtctaaccatatccaaagtaacaccacttgaactcctacttaccccacgcctccctcttccactttatatatga

SEQ ID NO: 236 - DNA, 1584 bp, Stylophorum diphyllum
atggctgcccttcttcccttagctttcctctacaatatctttttggcttcatcttcgaaagctactagcaagagaacaataagtactaagaaaccgcccatggtagccggtgcatggccaattcttggtcatctccatctgtttaaagagggtgagttgcctcaccaaatgcttaaatccatggctgacaagtatggtccagccttcctcatgaagttcggtcaacaccaatccctagttgtgagtgactaccgcatcgtaaaagaatgctttactactaatgataccctcttctgcaaccgtccatccactacagctttcgatgtcatgacttacgctaatgaatcggtagctttcacagaatacagtccttactggcgcgagcttagaaagatatccactctcaagcttctctctaacaaccgtctccaggccatcaagaacctccgagaagaggaggtggatgtgagcttcaaggggttgtatgattcatggaagaataagaacaacaagagtactgctggcagtgttggtgatgaacgagctccggttttggtcgacatgaagaaatggtttgaagaagtgtcaaacaacgtggtgattagggtaatcgtgggcaaatgtaattttgggactaagatcgtgcaaggtgagaaggagggtgtggagtacaagacaatcatggatgagcttttacgacttgctagtttgtctttgttatccgatttcgcccctatacttggtttgttggatttcttccaaggccatgtccgtaccatgaaacgaaatggcaagaaactagacgtgttacttcagaggtggttggaggagcataagaggaagaagagcacaccagaggatgagcaagacttcatggatgttatgctgtcgattattgaggagagcaagctgtctggctatgacgctgataccgtcattaaagctacttgtctggccatgatcatgggtggaacagacacatccgcagtgagtctaacatggatcgtctctttactgatgaacaatcgtcaagcactaaaaaaggctcgagaagaattggacgcgcaggtggggaaggatagacaagttgaagattcagatttaaagaacttggtttacttgaatgccatcgttaaggaaacaatgcgattatacccactaggtactcttcttgaacgcgaaactaaggaggactgtgaagttggtgggtttcacctcgaaggtggtactcgtttactagtgaacgtatggatggtacagcgagacccagacgtgtggactgatccgacaaagttcataccagagaggtttcttacggagaaggcagacatagatgttgggggtgggaattttgaacttataccattcggagccggtagaagggtgtgccccggagtgtcctttgcacttcaattcctaaatttggtactagctcgtctcattcatggatatgaattgggaactccagaagatgcggatgtggatctaactgagagcccagaaggacatgtcaaccacaaagcatcccctctcgagcttctcctcaccccacgcctcagtaaccctaagctctatgattattag

SEQ ID NO: 237 - DNA, 1644 bp, Stylophorum diphyllum
atggattctgatcatcaacttctcagttaccagttctctgcaagtaatatgtttatcagcctctttgcttttgttctctactatctactagtatggaggccaacaaaatctaatcttaagatgaaaaccatatcatctgaagacaagcaagcacccgaactcgccggttcatggccagttatcggtcatcttcatctccttcatggacctaacccactccatgtagctttgggagccatggcggacaagtacggaccagctttcaccgttcgagttggtgtccatcggacacttgttgtgagtagttgggaggtagcgaaagaatgtttcactaccaatgacaaggtctttgtatctcgtccacgtcaagcagcaggaaaacacatgggttacaacaacgccatgttgcgattcgcctccgatacaccatactggacccaaatccgtaaaatgttgaaacgagacctcctctctaacaaccggattgagttgctaaaccatgcatggcattccgagattaacacatccattaaagaactgtacgagatgaattggtcatcaggcgaaggacgtcgtggcggcattagaccgccggtctcggtggacatgaagcaatggcttggtgatttaaccctaaacatgtctgttaaaatgattgctgggaagagatgttttggcagtggtgtttctgcttgtgatgaaggagaagctagaaggtgtcaaaaggggttgaaagacttcgttaggttgatgggtcagattgtggtgtcggatgcaataccatttcttggatggttggatttggatggctacgagggggaaatgaagcgagccggaaaagagctcgaccgtttactaggaggatggttggaagagcataaaatgaagagatcaccaggtgatgaagcttcagcccagaaggactggatggacttgatgctgtccgtacttggggatggaaagcttgacggctattacgacgctgatacgatcaacaaagctacttgtctggctctattgcagggtggtagcatctggacgatgcttactttattatgggcatttgccttactagtgaatcatccacatgtgatgaaaaaggcccatgatgagctggacaaccatgtaggcagagaaagacaagttgaggaatcagacatcaagaacctcacttaccttcaagccatagtcaaggaagcaatgcgtctttactcggtgtcgatgcgactactcgaatccaccgcagactgcactgtttctggctacgatgtcccagctgggactcgtctaatcgtaaatacttggaagattcagcgtgaccctcgggtatggtccgacccatctgaattccatccagagagattcctcacacaccgccatagggacatggacttgtatggtcagaattttgaaatcacaccttttgggtcgggcagaagatcatgcccaggttcctcattgggtcttcaaatggtgcaactgacaatagctcgtttgctacatgggtttgagtttaaaacaccttcggacgcccccattgatatgactgagagtgttggggtagaaaatatggttaaagcaacaccaattgaagttctgctcaccccgcgcctcctcgatgaggtttatgctttctataattag

SEQ ID NO: 238 - DNA, 1687 bp, Stylophorum diphyllum
cttttgccagttccaaggtattgtaggaatcttattagctttcctaaccttcttatattatctatggcgggcttcaattacaggattaaggactaaacccaaacacaacgactttaaagtcactaaggcagcacctgaagctgatggtgcatggcccatagttggtcattttgctcagttcataggccctcggccacttttcaggattcttggagatatggccgacaagtacggttcgatcttcatggtccgatttgggatgtacccaaccttggttgtgagcagttgggagatggcaaaggagtgcttcactaccaacgacaggttccttgctagtcgtccagctagcgctgctggcaagtaccttacctacgactttgctatgttaagtttctccttttatggcccttattggcgtgagatccgtaagatctctatgctcgaactgctatcccatcgtcgcgtagagttgctcaagcacgtaccttccactgagattgacagctctatcaaacagttgtaccatctttgggtggaaaaccaaaaccaaaataagcaaggggatcatcaggtaaaggttgacatgagccaactactcagagatctgaccttgaatatagtattgaagttggtggtaggaaagcgtcttttcaacaacaacgacatggatcatgaacaggatgaagcagctcgtaagctccagaagacaatggttgaactcattaaagtggcaggggcttcagttgcatcggatgcccttccattccttggttggttggatgtagatggactaaagagaaccatgaagaggatagccaaggaaatagatgtaatcgctgaaagatggcttcaagagcatcgacaaaaaaaactaacatcaaacgacaagggtggcagcaacaacattcaaggtggcggtggcgataacgacttcatggacgtgatgctatccatccttgacgatgattccaatttcttcatcaattacaaccgcgatactgtcattaaagccacctctctgacaatgatattagcaggttcggacaccacaactctgtccttgacatgggctctaacgctattagccacctawcccctgtgtgccttgagaaaggctcaagatgaacttgatactaaggtgggcagggatagacaagtagatgagcgagacatcaagaacctggtctacctccaagccattgtcaaggaaacactacggatgtacccagctgctccactagcaataccccacgaggctacccaagattgtattgttggcgggtatcacgtaacagcaggcacacgtgtgtgggtgaatctgtggaagttgcaacgggatccacacgcgtggccaaacccatcggagttcaggccagagaggtttctagccgttgagaacgattgcaagcaacagggtacttgtgatggtgaagcagcaaacatggatttcagaggtcaacactttgagtacatgccttttgggtcaggaagacggatgtgtccaggaatcaactttgcgatccagatcattcacatgacactggcacggctacttcattcattcgagttgcgggtgccagaagaagaagtaatcgacatggctgaagattcaggtctaaccatatccaaagtaacaccacttgaactcctacttaccccacgcctccctcttccactttatatatga

SEQ ID NO: 239 - DNA, 1569 bp, Tinospora cordifolia
atggatttaccacaaccgaccatatcaaccacacttctagcttttttcagcatcttattattcatcatatgctatcgtctcttgagcactaaatctgacaagagatcatcatcttccagaaacaaacctcttgacgctcctggagcatggcccgtcatcggtcacctacaccttctaaacggcgtcatacaacacgaaattctgggaaccatggcggacaaatacggaccggcgttcaccatctggctcggcacgcgtccggcactagtggtaagcaactgggaagtggctaaggagtgcttcaccacctgcgataaggccttagcaagccgtcccccaagcttagctttgaagatcatgggctacaacgacgcgttattcgcgttcgctccttacgggcaatactggcgtgagttgcgcaaaatagtgatgattgagcttctttctagtcggcagcttgattcgctgaagcatgtttgggattctgaaattgattcatgcatcgaagatttgtatgaaaaatgtaagggtcatcgtgaaacagtactggtgaatatgaagcagtggtttgcggatttgatgatgaacgtagtggtgagaatggtggttgggaagctgaattttgggaaaacgaaagaaggtgatgatgaggtcgcgaaggcgcaccaagggcagttgaaggcgatgagagagttcttcaagtgggtggatgtgtttatgatagaagacgcgtttccgattctgacttggttggatcctcaagggtatcaaagaaaaatgaagaatatagcgaaagatctggactcgctggttcaggggtggttagatgagcataagttgaagcaaaaaactggcgataatgggaagaaagacttcatggatatcatgctgtcggcggtcaaagatgctagtatatctgacagagacgatgagacaatctgcaaggcgacgtgcttgaatataattcttggggcgagtgataccacaacggtgaccctcacatggaccctttctttgttactaaataatcgacatgtcttgaggaaggcccaagaagaattacaagcacaagttggcaaacacagatgcgtggaagaatcagacgtcaagaaccttgtttatctacatgccatcatcaaagaagtgctaagactttacccagctgttccgcttttaggcccacgagagagtgtagccgatactgtggtggcaggctaccatatacccgcaggcacacggctaatcgtgaacctttggaagattcatcgagacccgcttaactggcctgacccgcttgagtttcgacccgagagattccttacgacccacaaagacacagatgtgtggggtcagaattttgagttgactccttttggatccggaagaaggatatgcccaggtatttcgtttgcgcttcaagtaattcctctcacactggctcgattgctccatgggtttgagctcaccacaccaggtagtgcaccggtggacatgactgaaagcactgggctcaccaacttgaaagccacacctttagatgttttcatcagtccacggcttgttctttga

SEQ ID NO: 240 - DNA, 1581 bp, Tinospora cordifolia
atggagtccattcccacagcaattaatgtgcttcttgccttcgtctccatctactatcttctgaagttccggaaaaagatcatcacaacgactagagatatcaagaagatcaaagcaccagaactaaagggtgcatggccgatcataggtcaccttcatctattcagatccgatgatcttctgcatcgaaagctcggtgccatggccgacgagttggggccagcgtttatgatccggctaggtatgcgccctgctcttgtagtgagtaactggcaaacagccaaggagtgctttactaccaaagacaggatcttcgcaacccgtcccgattcggttgctgcgaagcacatgggctacgaaaatttaatattgggcttcactcgttacggaccttactggcgtgaggttcgcaagattgtcacgctcgagcttctctccagccatcggctacacctgctcaggcatgtcaggatatcagagattgacatgtccattaagaaactccatcagctttgtaccagtaacgacaacaaatattcatcagttgtggtcgacctgaatcaatggtttaaagctttaactcttaatataatcgtgagaataatagcgggcaagcggtattacggtggagacctcgaggacgatgaggagtcgcggcggtggaagaaagctcttaacgaatttatgcatctctttggaatattttcggtgtcggatgcgattcctcagttgcagggtatggacgtgcagggacatgagcgtgtcatgaagaggactggtaaggatattgatgtgattctgagcaaatggttggaagagcacagaaggaagaagatcagggttaacagggaaggagctgagaaagatttcatagatataatgcttgacctaatcaaagaaaacgtcaatatctccggtcatgatgctgataacgtcgttaaagccacttgtttggcccttgtatcagcaggaagtgatactacaatgatcactctaacatgggctgtgtcgttacttctgaataatcatcgagtcttggagaaagctcaagccgagttggataatcaaattggaataaacagagtacatgtagaagaagaggacatcaagaatctaccataccttcaagcaattgtgaaggagactcttcgcttatatcctgctgctccattttcattgccacatgaggccatggaggaatgtactgttgcaggcttccatgttccgaaagggacacgcttaatcacaaatatctggaagctgcaacgagatccccaagtctgggaggatcctttggagttcaggccagagagattcctcacaagtgatcgtcgtcatgtggattttagagggcaacattttgaattaataccatttggatcaggaagaaggatgtgccctggcatttcatttgccattggtgtcttgcacctgacgcttgcgcgtttacttcatgaattccaccttggaactccgaccaacgcacccatagacatgaatgaaaatccaggaattaccctcgagaaagcagatcctcttcatccactcgtctctccaagacttacttccatcaactactga

SEQ ID NO: 241 - DNA, 1617 bp, Tinospora cordifolia
atggattcccagttaacttcgtttcaatccaagcccagtgcatatctaattgctgcacttcttgccttagtttctgcatactatctcatcatcaagaagaaaagcagagcaacttaccaagataactacggcaagattagggcaccggaaccaaagggtgcgtggccaatcatcggtcaccttctcctgttcaaacccaacgatgtgctgtatcaaaagcttagctcgctcgcagacgagttaggaccagcgttcatgatacggctgggcatgcgctcagctctcgtaataagtaactgggaaatagccaaagaatgcttcaccaccaacgacaggatcttcgcgacccgtccaaagttgatggcctcaaagcacatgggctacggtggcgcagaagtcggcgtcgcgccctacggtccctactggcgtgaggttcgcaaaatcatcacggtagagcttgtctccaaccaccggctcaacttgctcaaggacgtcaggatatcggagatcgatatgtccttaaaagagctctatgatctttgtatgaagaagaagaagaacggcagtggagaagaatcatcgcgggttgaattggacctgtaccaatggttcaaggacatgtcgctcaacatattggtcaagctcatcgcgggcaagcggtattacggggtggccgctgccgccaacgaagatgaggaatcgcggcggtggaagaaagcaacggaggaatcggttttcctgtttggacaatttgtggtgggggatgcgattcctttgttggagggtgtggatgtgcaagggcttgagcgtgccatgaagaagactggtaaggaaattgatgcagttttgagtaaatgggtggaagagcatagaatgaagaagcagcagcttaatggggcaagagatgagcaagatttcatagatgtgatgcttaacataataaaggatggcaagatctctgatcatgatgctgatactatcgttaaagccacttgtatgtctcttgtacaagccggaagtgacaccacaatgcttaccctgacttgggctgtgtgcttgctactaaacaattgcaatgttttagagaaagctcaagcagagttggatgatcaaattggaagaagcaaaggacgtattgtagaggaagatgacatcaagaaactgccttatctccaagcaattgtgaaggagacttggcgcttgtaccctcctgctccacttgctgtaccacgtgaagccatggaggactgtactgtagctggcttccatgttccaaagggtacacgcttaatgacaaacatatggaaactgcatcgagatcccaaagtgtgggacgattctttaaagtttaggccagaaagattcctctccagtgaacatgcacatgtggattttagagggcaacagcatgagtttatgccctttggatccgggagaaggatgtgccttggaatgccattagctattggtgtggtacaccttacacttgcccgtttacttcatgaattcgagcttgcaactccgtcaaatgcaccagtagatatgagtgaaaaagctggtcttactttggttaaagcgacgcctctaaatgttcttatcgccccacgcctttgctaa

SEQ ID NO: 242 - DNA, 1596 bp, Tinospora cordifolia
atggattcaataatactccagagtaaccttcttaccactgttataataataacatcctttggcctctttgtcctttccttttactatgttctctggaaggcaattagaactggcaacaagagaaattgcagcaaccctaaggctcctgaagctgctggaggatggcccattctcggtcatcttcatttattcagaggccaaggcctattactgcacaaaatttttggagccatggccgaaaaacacggaccagcattcaccattcggctcggaatgcgtccggcactagttgtgagcaactgggaagtggctaaggagtgtttcaccgcaaatgatcgggcccttgcgagccgccctacgagcttagccttgaagattatgggctacaacaacagcttgttcgcgttcgctccatacgggcaatattggcgtgagttgcgcaagatagtgatgcatcagcttctctctagccgtaggctcgagttactcaagaacgtttggctttctgaaattgatatatggatcaaaggcttgtacgagaattccttggttaataaagtggtggatatgaagcagtggtttggggaattgatgatgaacatagtggtgagattggtagcaggaaagcgaagttttgggaaaatcagagaaggcgatagtgaggaagcgaaggcgcatcagcggcaaattaaggcactgcgagatttcttcaggttggtggaggtttttatgatagaagatgcgtttccttttctaacttggttggatcctcgagggtatcaaaaagaaatgaagaatatagcaaaagaactggattatcttcttgaggagtggttagaagagcataaactgaagcaacaagctgcatgtgatgatcagagcaaggacttcatggatgttatgctgtcggaggtcaaggattctactatcactgaaagagatgcaaacacaatctgcaaagcgacttgcctgaatgtaattttaggtgcgagtgataccacaactctgactctcacatgggccctttccctactactgaacaacagacacgtattgaagaaggcccaggaagaattaaatgcccaagttggcaaggataaacaagtggaagaatcagacatgaagaaccttgtgtacctacatgccataatcaaagaagttctaagactctacccagctgctcctttgtcagtggcacatgagtctttagaagacaccgtggtggctggttaccatgtctccaagggcacacaggtcatattcaacctttggaaaattcaacgtgatccatctgtatggtccaacccgctagaattccaacctgagagatttctcaccacccacaaacatgtagacatttggggtcagaattttgaattgataccgttcgggtcgggaagacggatgtgcccaggcgttcctttcgctcttcaagtggtttccttaacgttggctcgattacttcatgggttcgagctcacaacaccaggtggcgcagctgttgacatgaccgagactcctgggctcactaatatgaaagcaaccccggtagaggttttccttagacctgacctccctcaccagctctatgcttga

SEQ ID NO: 243 - DNA, 1575 bp, Thalictrum flavum
atgccaagccaaaccatacaaattataatggatttctttcatcaatgtgttgcaactatattattttgtgtcttagcttcaccttttttcttttattatctactcccatggtggaaaaatgctaatgatcatgatcttgccaagagcagaggaaagcctgttcctgaagtagatggtgcatggcctattatcggtcatatgcatatgctgcaaccatcagatagcttttactcatctttggcggaaaagtatggaccaattttcacacttcgaattggtttatgcaaaacaattgtgattaatagttgggagctagctaaggaatgttgtaccactcatgatagagtgtttgcaagctcgcctgaagctacagcggcaaagatattgggatatgattatgctatgtttggacgaaacccttatgggccttactggcgtgaaatgcgcaaaataattataactgaacttgtgtcaaatcggagactggagctactaaaacatattagagtaacggagatcagtacatccatacaagaattgtaccagttgtgggaagcaaggagtagtaagaatgtaaaagaaagagttgtggtggatatgcaaaaatggtttggtgacttgatgctaaatattggtgtcgagatggttgctggaaagagatattttggtgcaagttcgaatgaagataaagaggaagcaagacagttgcataagacatttaaagatttctcgaacctatttggagtgcctgtgctatctgatgcaattccatttcttaggtggttagactataaaggacatattaaagccatgaagagatgtgcaaaacaagtagattgtatcttgcatagatggttggaggaacataaacaaaacaagacaacaattgctggggatttcatggatattttgttgtcagtacttcaggataaagagatctttggtagggatgcagacaccgtaatcaaggctacatgtctgaatatgatgctgggtgttgtagaaaccaataaggtcactgtaacaatggcactcatctcattgttgaacaatcgtcgcattttgaagaaggcacaagaagaaatagacattcatgttgggagcgataaacaagttgaagaatcagatatagagaaacttgtatatctccaagccattgtcaaggaaacgttgcgcttgtactcacctggtctaggaacacgtgagccctcagaggactgcaccatatcaggtttccatgttccaaaaggcacagaggtaatggtaaatgttcagcagattcatcgagatccaagcatttggtctaaccctcttgaatttcaaccagagagattcctcaccacacaagcaaatatagactttgggggtcaacatcatgaatacattcctttcggggcaggccgtagattatgccctgcaatctcattcgcagttctggtggtgcacttgacactagcacgtttgctgcaagggtttgattttgcaacaccaaaggatgcacctgtggaaatgaatgagagtgtggaaactctggaagttttaatcaccccacgactccctttgcatatgtattaa

SEQ ID NO: 244 - DNA, 1605 bp, Xanthoriza simplicissima
atgcacaatcccataccaaaccaatggctaccaagttcaactcttctgacgcctatcattgttagtttcctcgttatcgttctcttctatatctataagaagagaagtagtaacacgatcaggaccaagaaggcgcctgaagtagtaggagcatggcctgtaattggacatctaaatttatttagttgtcctaaaccgggtcatatagtgctgggcgaactagctgatcaatatggccccgcatttactatccattttggtatgcatccaacactggtggttagtagttcggagctggtgagggactgtttcactacgaatgacaaattattttccagccgtctagttaacaaagccatcaagtacatgttctacgatcaggacactatttcattcgcaccttatgggccttattggcgtgagcttcgtaagatgattgctcttaatcttttaaataatgaacgcatcaaaatgctccagcagcaaaggatttcagagatggatgcttgtttaaaaaagctgtacgatttatcagcaaaaagaaaagacgagaacgcaggggtattggtggatatgagtaaatggtttgccgaaatttcctttaatgtggttaccagaattgttgctggaaaacatatttttgggcctaaagttgaaagatacaagaatgtgatggaagaggcacgccgtcttatggacgtcatggttttctccgacatggtaccttatttaggatggttggatagattgcgaggagtggacagtgctataaagcggacagccaaagaattggactctgttcttgagagctgggtggaggaacatcgtcgaaagagcgtgtcaatctcagctggaacgggaggcattttcaacataaaagaagaggaggaattggattttatagacattatgttgtcgattatagccaagaacaatttaccaggtgacgatcctgatactttaatcaaggctattgtccaggaaacgtaccttgctgcgtgggacaacacaacggtaactcttacatgggtcttgtgtttgttattaaacaataagcaagttctgaaaagagctcaaaatgaattagacgctcaagttgggaaggagaggcaagtagaagattcagacattaataatcttccctatgtacaagccattgttaaagaatcattgagattatatccaccaggaccgataattgaacgggcgactactgaggattgtaacgttggtggcttccgcgtcccggcaggtacacggctttgggtaaacttatggaagttacaacgagacccaaaagtatggcctaatgatccgctagaatttcgaccagaaagatttctcaatgacaatgcagacattgatttgaggggtcagaattctgaattaataccatttggatcagggaggcgcatgtgtcccggtgtctcattttctcttcaagtcatacatctggtgattgctcgaataattcagggatttgagttaaaggccccaacagatgcagatatcgacatgtctacaacgctaggaatgataagctggaaagcaacaccacttgaagtactcatgaatccacgcttcccacccgtgttttacaagtga

SEQ ID NO: 245 - DNA, 1653 bp, Xanthoriza simplicissima
atgtctacattacaaattagcattttaacagttaaatccccgtattcacaaatgcattattatccccttcttcaccaatggctaccagcttcaatggcgctagtcagtttgctcgttatcattctcttctctatcttcaagaagagaagtagtaagatgatcaaggccaagaaggcgcctgaagtagcaggtgcatggcctctaatcggacatctcaatctatttagtggtcctaagctacttcatttagtacttggagaactcaccgatcaatatggaccggcctttatgatccatcttggtatgtatccaactttggtggtgagtaattgggagcttctaaaggactgtttcactacaaatgacatattcttctcaaatcgtccagttaacaaagcgatcaagcacatgttctacaataaagagtctattggattcacaccttatggatcctattggcgtgagcttcgtaagatgactactctcaaacttctatcaaaccaccgccttgatctgctcaagcccttgagaatttcagagatggacgcttgttttagaaacctttatgagttgtggacgaaagataaagacgggaatgcatggctgttggtggatatgagtaaatggtttggcgagatctcgtttaatgtggttgcaagaattgtagctggaaaaaagaattttgggtccaaaggtgataggtataagacagttatggaagaggtggtccgtcttatgggtctcagagctttgtcggacgcggtaccatatttaggatggttggatcagttgcgaggactggacagtgctatgaagcgggcggccaaggaattggattctgtgcttgagagctgggtggaggaacaccgcctaaagagggtgtcagtttcagctggaactggaagcactgtaaagacagcaaaagaggaggaggaggaggaggacttcatagacattacattgtcgattttggcggagaaccaattaccaggtgatgatcctgataccggcatcaagtctcttatcctggacatgatcctgggtgggagcgacacttcaacggtgacactaatatgggcaatgtgtctgctattaaacaatgtgcatgtgttgaaaagggctcaatatgaattggacgcacagattgggaaggaaagacaagtagaggattcagacataaagaatctgccctacatccaagccattattaaagaaacaatgagattatacccagcaggaccgattatcgaacgccaggctaatgaggactgcgacgtgggtggcttccatgtcccagcaggtacacggctatgggtaaacttatggaagttacaacgagacccaaatgtatggaaggacgacgcattagagtttcgacctgaaagatttctcactgatcatgcagacattgatttgaagggtcagcatctggaattaattccatttggatcaggtaggcgtatatgtcctggtatctcatttgctcttcaagtcatgcatttggcacttgctcgaattattcatggatttgagttgaagaccccaaatgattcaaatatcgacatgtctggaactcctggacttttatgctgcaaagcaacaccactccaagtactcctgactccacgttttaaccccatgttttataagtga

SEQ ID NO: 246 - DNA, 1563 bp, Xanthoriza simplicissima
atggattcacttcgacattgtttaggaggtattcttgccttactaatctttcttggttatctgcaatggaagagaggaacaagtaacaagtgcatagaagctcctcaaccggatggggcatggcctatcataggccatttgcctaggttgatgaaaccccaaataatgcatagaacgttgagcaccatggctgataaacacggcccagcgtttactctccggcttggcgtacataaaacattggtggtgagtagttgggaggtagccaaggagtgtttcactaccaacgacagagtcttcgctacccgcccaacctctatcgccgtggagatattgggctacaactacgccttatttgcctttggtccttatggctcatattggcgtgaagcccgcaagatagcaatacttgagcttctctcaaaccataggctcgagttgctgaaacatgttcggatctctgaggtgagcacatctataagagaattgtaccaagtgtggaaagaaaattgtgatatagcaaatggatctgctttggtggatatgaaaccatggtttggtgacttgacactaaacgtggttgttagaatggttgctggaaaacggtacatgggtggcagtgttaaatcggatgatgttgagggaaggcgatttcagaaggccactaaagatctctttgatttatttggactgtttatattgtcagacgcgcttccatttatgggttggttagacctccatggccataagaaagccatgaaaaaaactgccaaggagctggactccattatgcagagatggttggaagaacatcgacaaagtttattggatgatggaacaaaggaggagaagaaggacttcatgtatgtaatgttatctatccttgaggataaaaagctatttcaatatgatgccgacatcgttaacaaagctatttgcatgaatatgattatggcaggtactgatactcaaatgatcactctaacatgggtcctttctttactactcaacaatcgacacattttaaagaaggcccaagatgaaatcgactccagtgttggaaaagatagacaagtcgaggagtcagacatagtgaaactagtgtacctccaagcaattgtgaaggaagcattgcgtctctacccacccgctcctctatccgcacaacatgaggccatggaggactgcactgtggctggctactatgtcccagctggcacacgcctaataacgaacatacggaagattcaacgagatccacgcgtatggtctgacccttttgagttccatccagagagatttctcacaaaccaagcaaatgtggactttagaggtcaatcttttgagttcattccttttggatctggaagacgaatgtgcccaggcatttcatttgcgcttcaagtggtgcatttgacattagcacgtatcctacaaggttttgattttgaaacaccaatgaatgcttctgtggacatgactgaggcaccaggtctgacaaatgttaaatcaacccctcttcaagttctaatcaccccccgtctccacccaaacctatattaa

SEQ ID NO: 247 - DNA, 1572 bp, Xanthoriza simplicissima
atggatttacttaacccatattttgcaactatctttggtggtttctttgcgttactaatttttctttttatcatttcacagaagagaagtaggattcccaagatcagagcagctccagaaccagttggggcatggcctatcgtaggacacttgcctatgttacttggacccagattaccccattttgtgttgggagaccttggagagaagtacggatcagcatttactctccggcttggcatacataaaacattagtggtgagtagttgggaggttgccaaggagtgttttactacaaatgaccaagtattcgccacccgccctagcttcatggcagcgaagataatgggctataattatgctctatttggcttagcaccttacgggtcatattggcgtgaactccgtaaaatatctattattgagcttctttcaagtcataggcttgaattgctgaagcatgttcgagtctctgaggttagtacatcaatgaaagaattgtacgaggtgtgggcagaaaactgtagtaatggaaacggatctgttttggtggagatgcagcgatggtttggtgacttgacactaaatataagtgttaggatggttgctggtaagcgatactttggtactagtgctagtttggatgacgacgaggcaaggcgaatatcaaaggccacaaaagatttcttccgtttgacagggatgtttgtggtgtcggactcggttcctttcctttggtggctagattttcagggccacgagaaagccatgaagagaaccgccaaggaaatggacgatatatttgggggatggttggaggatcatcgacgaaataaacttgctggtggaacaaaggtgcagcaagacttcatggatgtgatgttgtctatccttgaggacgaaaagttctttggttataatgccgatgttgtcacaaaggctacttgcctgaatatgttgttgggtgggacggataccacaatggtcaccttgacatgggccctctcattactactgaacaaccgtcatattttgaagaaggcccaaactgaaattaacactcatgttggaaaagatacacaagttgatgaatcagatatagtgaaacttgtgtacctccaagcaattgtcaaggaaacattgcgtctctacccagctgctccactatccacaccacacgaggccactaaggactgcaccatcgctggctaccacgtcactgcagggacgcgcttgataacaaatatatggaagattcaacgagacccacgcgtatggtccaaccctagtgagtttcaaccagaaaggtttctcactgatcaagcaaatgtggacgttaggggccaacattttgaattcattccttttgggtccggtagacgatcctgcccaggaatctcgcttgggctacttgtggtgcagttggcattagcacgtttgctacaaggctttgatttcgaaacaccatcggatgcattggtggacatgactgagagcgctggattaactaatctcaaagcaacacctcttcatgtcctaattacaccgcgtctccattcaagcctgtattaa

SEQ ID NO: 248 - DNA, 1593 bp, Xanthoriza simplicissima
atggactcagttcaccaaggccaatacctaccaactccgatggtcagtgtctttgtgttttttatcagtctttactttctaattgtgtggaagacaaggtctagttccaagactaacacttgcaacgaagtacccgaagcgcctggggcgtggcctattatcgggcacctccatttgttaggtgggagtgaattaccccacaagacattaggagccatggctgataagtacggcccaatctttaagattcgtattggtgtgcatcaagcattggtggtgagtagttcggatattgtaaaggagtgtttcactactaatgataaggtttttgcttctcgtcctacctcgacagcatcaaagatcctgggctatgattatgtcatgtttggtttctctccttacggaccgtattggattgaactacgcaaaataattatgtcggaacttctctcaaaccgcaggctggaactactaaaacatgttagggactctgaaatcgatatatctatccaagaactatacaaggtgtggaagaatcatgataagtcaaaaggtccaatcttagtagacatgaagcaatggtttggagacttggcactcaatgtgattctaaggatgattgccggaaagagatactctggttcaatcttttcttctgatgagacagaagcaaggagatgtcaaaagggagcgagagatttctttaggctgttggggctattcatcattgaagatgcacttccgtatctaagttggttcgacttacaaggttacaagaaagagatgaagaacacggcaaaagaacttgattctgtttttcagagatggctggaagagcataaacgaacgagagaaaccggtgaactgaatcgggagcaggacttcatggatatcttaatgtccacactggaagagacaaagatatctgaatacgacaatgacactatcatcaagtctacttgcctgagcattgtaacaggtggaaatgacactacaatggttactctcacttggatcctatccttacttctaaacaataaacatgcactgaagaaggttcaagatgagctggacagccacgttggaaagcatagacacgtggaagagtcagatatcaagaacctcatctacctccaagctataatgaaggaagccttgcggttgtaccctgcaggtccactatcaggtcctcgggtggcagacgctgactgcaccttagcaggctaccacatcccagcaggcacccgcttacttgtgaatacctacaagattcaaagagatccattggtgtggtctgagccatctgagttccgaccagagagattcctcactagccatgtaaacatggatgttaagggtctgcaatatgaattaataccttttgggacaggtaggcgtgcgtgtccagggatgttatttgcgcttcaagtggtgccactagtcctggctcggtttctacatgagttcgagccaaagactgaaatggatatgccagtggatatgacggagactgcgggactaagtaacgccaaagcaacgccactagaagtagtaatcaccccacgccttcagcccgagctttatagtttataa

SEQ ID NO: 249 - DNA, 1587 bp, Xanthoriza simplicissima
atggacttcaccatgatcatccaatggcttctcacatcctttgctattcttgttgcatttgttctaatctggtctagtgcaacaagatctagtactaggaaaagaaacaaaacagcacctgtagctgctggtgctttgcccattgtaggacacctacatatgctaatgggacgagaactgcctcatcgattgctttcaaatatggctgacaagtatggtcctgccttcatgatgaagtatggcttacaacctgcacttgtggtgagcagtttgaagctcactaaagagtgttttgttcacaacgatagagctgtttttaaacgtccaagaagcaaagcattgaaaaacttgacctatgatcaagcttctttgggttttgcgccatatggaccactttgggtggagatgcgaaaagtatctaaaactaatctcctctctaaccaaaggcttcaaatgcaaagacatgtaagagcctcagaagtcgacgctttcatcaaagagctttacgatctatggtcttccaaatccaacaacatcaaaggcgcgccacttttggttgaaatgaataaatggtttgaagaactggcacttaacgtagtgaccaggatgctgagtggaaaaagacacattggctttaaggcaaggcgtggtgaagatagtgaatctatgcattataagaaagttgtagttgatgctactcttttaactgcaaagcttgttgtgtcagatttctttccttctcttggattggtggactacttgcaaggtgacgagagctctataaaggggacaagcaaagaactagacgcgatcctcgccacttgggtggaagagcatcgccataagaaggtttcaggctcagaggatgatgagaaagacttcattgatctcactttgtccatgatagatcaaactcagcaccaaggtgcagatgtcgacaccttcatcaagtctatgtgtgtgggcatgatctttggtgggagtgatagcacatcagtggccttagcatgggctctttccatactgatgaataatcgtcctgttttgaagaaagcccgagaagaaatcgatcgacaagtaggtagagataggaaagtgaacgatttggatgtcctcaaattggattatctcaaggcaatcgtaaaggaatcgatgcgattatgcctagtcggaccgcttcttgaacgcgtcgccgtagaagattgtgagataggcgggtatcatgttaaagcaggctcgcgcgtagtagtgaatatttggaaaatgcaacatgatccaaacttatggtctgatcctttggaattccaaccagagagatttctcactacaaacgcaaatgttgaacttagaggccagcatttcgaactccttccatttggagctggtagtcgtatttgtcctggaattacatttgccctcgaacttattcagttaacacttgctcgtctaattcatggatttgaactgggaactccgatggatgcagacgtcgacatgacagaaacatcaagtgttaccaactatagggcaacacctcttgaaatattactaacaccacgcctggatccaaagctttacaattattag

SEQ ID NO: 250 - DNA, 1515 bp, Argemone mexicana
atggaggaaaaaatcatgactaacaatagtccatggattcttacttcatcaacaacaacaacaacaacaatattactatcattactctttactatcttcataattttaagaagaaacaaatcatcatcatcaaaaatggtatggccaacagggccaaaaaccttaccaattattggtaatatgaatattcttggtggtacagctcttcatgtcgttttacataacctagccaaaacttatggtaacgttatgactatatggattggtagttggagacccgtgatcgttgtttcagatatcgatcgagcttgggaagttcttgttaataaatcttcagattattcagctcgagatatgcccgaaattactaaacttgctacagctgattggaaaacaatttctagttctgattcaggtcctttttggactaaccttcgaaaaggtcttcaaaatgtagctttatcacctcaaaatttatcatcacaaagtaaatttcaagaacgtgatataatcaaaacgattcaaaatttgaaagaagaagctaaaatgaataatggaattgttaaaccacttgatcatcttaagaaagctatggttagattaattagtcgtttaatttacggtcaagattttgataacgatgaatacgttgaagaaatgcatcatactatcgaagaattgatacgtgttagtggttatgcgcgtttagctgaagcattttattatgctaagtatttaccaagtcataaaaaagctgttagagaagtcctacaagcaaatcaaagagttcaaaatctagtacgtccgcttttatcgttaaattcacctactaatacttacttacattttcttagatcacagaactacgaagatgaagttattatattcgcgatatttgaagcttatcttttgggtgtagatagtacttcttcaactacagcatgggcactcgcgtatttaatacgagaaccaaatgttcaagagaaattatatgaagaacttaagaattttacgaacgataacgatcgtaaaatggtgaaatttgaagatttaaacaagttacaatatttacaagctgtagttaaagaaacaatgaggatgaaaccaattgcaccattagcaatacctcataaagcttgtagagaaacttcattaatggggagaaaagttaatcaaggaactagggttatggttaatatatatgcattacatcataatcaaaatgtatggaaagaaccttataaatttaatccagagagattcttacagaaaaatcaagatggtgttgatggtaaagcaatggagcaatcactattaccatttagtgcaggtatgagaatttgtgcaggaatggaattaggtaaacttcaatttagttttgctcttgctaatcttgttaatgcttttaaatggtcttgtgtttctgatggagtatttcctgatatgagtgatcaattagggtttgttttgttgatgaaaacaccactcgaagctggtattgttcctcgtatgtaa

SEQ ID NO: 251 - DNA, 1167 bp, Argemone mexicana
atgcctgatattactaaaattatttcagcaaattggaaaaatatttcatgttctgattcaggtccattttggcataacttaagaaaaggtcttcaaggtgttgccctaactcctcttaatgttgcatctcaatatcatttacaagaaagagatatgaaaaatttaatcaattccatgtacaaagacgcgtcgcaaaaaaatggaattttaaaaccacttgattatcttaaagaagagacggttcgattactaagtcgtctaattttcggtcaagattttcaagatgagaatttagttgttggtatgcatcatgccctagatgatttggtacgtataagtgggtatgctagtttagctgatgcttttaaattttgcgaaaatttaccaagtcataaaaaatctattagagaagttcatgaagttaaaaaaagagtcgaaaatttgattcgtccacatattgtttcgaatcctcctacaaatacttacttacattttcttaaaactcaagattttaacgaagatattataatatctgctattcttgaagtttatgacttgggtgtcgatagtactgcatcgacaactgtttgggcattaacgtttttagttcgcgaacaagaaattcaagaaaaactttatcgcgaaattgtaaatgttacgggtgggaaaagatctgtgaaagttgaagatgtgaataaaatgccttatttacaagcagtaatgaaagaaacaatgaggatgaaacctattgcaccaatggcaataccacataaaacttcaaaagaaacttcattaatggggaaaaaaattaataaaggttcagtgataatggtgaatctttatgctattcatcataaccctaaggtatttcctgaaccatataagtttatgccagagagatttttaaaggatgttaatagtgatgaaagtttgggtaatattaaaacaatggaaagttctttattagcatttagtgctggtatgagaatttgtgcaggtatggaattaggtaaacttcaattagcttttggtcttgcaagtttggttcatgaattcaaatggagttgttctgttgatggaaaattgcctgatcttagtgaagatcattgtttcattctcttgatgaaaaacccactcgaagcaaaaattactcgtcgcatccattga

SEQ ID NO: 252 - DNA, 1470 bp, Berberis thunbergii
atggagttcactgtatgggttgtgggttttaatgtccttgtagtagtagccatgacaatgttcttacttagaacaaagtcatcttcctccacaacaaaatggcctattgggcctaagaaactacccatcataggtaacttgcatcaactcggaggcgacgtgctccacgttgctttagcgaagctcgctaaagtgcatggtggcataatgactatctggattggaagttggcgaccagttattgtcgtcagtgacatcgacaaagcttgggaggtgcttgttaacaagtcctcagactactctgctcgtgacatgcctgagattaccaaaattgcttcagcaagctggcacaccatctccagttccgactccggcccattttggcaaaacctccgtaaaggcctccagaatggagccttaggcccggctaacatctcagcacaaagccaactccaggaaagagacatgaagagaatgattggagacttgcaaaaggaggccaagatcaatggtggaattgttaaaccacttgatcatattaagaaggccactgttaggctactgagtcgcctcatcttcggacacatgtttgatgatgattcatttattgaatccatgcaccatgagattgaagatctcattcgcataagtggctatgcccgtcttgcagaagccttctcctatgctaaatacctccctagccataagcttgccgttaaagaagcgtatgaagtgaaacacagagttgagcaactggttcgaccacttctcacttcaagccctcctgcaaatagttacctaaacttcctcctctcacaagattactcagaagaagtcattatcttttgcatatttgagatatatctcttaggtgttgatagcacttcatctaccacaacatgggccctttctttcttgatacatgaacaacaagttcaagagaagctctaccaaagcatcaaaggagtcacctcagatgatgacggccttgtgaaagcggaagacttaagtaagttacaatacttacaagcagtgatgaaggagacaatgagaatcaaaccaatagcacctttggcaatcccacacaaggcatctaaagacaccaaattgatgggtactaaggtagcgaaaggaacgcgtgtcatggtgaacctttatgctttacatactaaggaaaacatatggtctgatccagagaagttcaagcctgagaggttcttgcatggagatgaaggtgctaatgtgaaggcaatggaacaatgttttttaccattcagtgcaggtatgagaatctgtgcaggtatggagttgggaaagcttcagttttcaattgcacttgctaatttggtgaaagctttcaagtggacaagtgttgtggatggggagctcccagatatgagtgaagaactgtcttttgttttgctcatgaaaactccacttgaagcaaggatcattccaaggcacctttga

SEQ ID NO: 253 - DNA, 1506 bp, Corydalis chelanthifolia
atggttaatgctgttgcagagattttgacggagaaaccatggctccttcctgctactctactagcagtcatagccattgcaaagttcttcctcggaaaatcttctaccatgaaatggccgattgggccgaaaacgttaccaatcatcggtaacatgcatcaacttggaggtacagaccttcaagttgtcttggctaatttggccaagacatatggtaccattatgaccatatgggttggttcttggcgaccaatgatcgttctaagcgacatcgagaaagcttgggaagttcttgtcaacaaatcctctgattactccggacgtgccatgcccgagatcactgaaatcatttccgcgaaagggaaaacgatttccacttctgactctggacctcattggagtaatctccgaaaaggtttacagaacgtcgcgttgtctcctcataacatagcggcgcagagtcggttccaagagagtgatatcaccaaaatgatcaagactttgaagcaagaagcagcttctaacaatggaattgttcagcctcttgatcatttaaaaaaatctactgttcgattgatcagtcgtttgattttcggacaagattttgatgatgatgaatatgttgaggcaatgcatcttgctgtcgaagaattgatccgagtttccggatatgctcgtttagctgaagctttctattatgctaagtatttacctagtcataaacgagctgttagcgaagtttgggaagcaaatcgaagggttaaacgtatagttaaacctcgtctttcagctaaccctcctccaaactgttatctacatttcttgagttctcaagattactctgaggagatgatcattttcgccatcttcgaagcatacctcctcggtgttgatagtacttcttcgacaacagcttgggctctcggtttcttaatccgtgaaccaaaagttcaagagagactttatcaagaactcaagaactgtgccggcgaaaacggattgattaaggtggaagacataaacaaactaccatatctacaagcagtgcttaaggagacaatgaggatgaaaccaattgcaccattagcaattcctcacaaggctgtcagagagacatctttggctgggaacaaggttgaaccgggaacccgtgttatggttaatctatacgcgattcatcataacccgaaagtatggatcgacccacataaattcaaacctgagaggttcttgcaaggagaagaaaatggtggtggaaatttgaagttaatggagcaatcactgttgccattcagtgctggtatgaggacttgtgcaggtatggaattggggaaacttcaatttggattttcacttgcaaatttggtgaatgcatttcaatgggattgtgctaagaaaggaatgttccctgatatgagtgatttgcttgggtttgtgctgttgatgaagacacctcttcaagcaaaaattgttcctagaggatcaccctccattaatggttactag

SEQ ID NO: 254 - DNA, 1512 bp, Corydalis chelanthifolia
atggttgcagctgttgtagaaattttaaaggagaaagcatggctccttcctactactctagtagcaatcatagccattgcaaagcttttcctcgccaaatcttctactgtgaaatggcctacaggtccgaaaacgttaccaattataggtaacatgcatcaacttggaggtacggagctccaagttaccttgactagattagccaagacatatggtaacattatgaccatatgggttggttcgtggagacccatgatcgttgtaagcgacattgagaaagcttgggaagttcttgtgaacaaatcctcagattactctggtcgtgccatgcctgaaatcactcaaatcggttccgcaaattggaaaacgatttccacttctgattctggacctcattggagcaatctccgaaagggtttacagaacgttgcgttgtctcctcataacatcgctgcgcagagtcgattccaagagagtgatatcagcaaaatgatcaaggctttgaaacaagcagcagttgctaacaatggaattgttcttcctcttgatcacttgaaaaaaactactgttcggttgatcagtcgtttgattttcgggcaagattttgatgatgatgaatatgttgaggcaatgcatcttgccatcgaagaattgatccgaatttccgggtatgctcgtttagctgaagttttctattatgctaagtatttacctagtcataaacgagctgttgacagtgcttgggaagtgaatcgaacggttaaacgtatagttaaacctcttcttttggtgaaacctccaacaaattgttacctacatttcttgacatctcaagattactcagaggaggttatcattttcgccatcttggaagtataccttctcggagtcgatagcacatcttcaacaacagcttgggctctcgggttcttaatacgtgaaccaagagttcaagagaagctctatcaagaactcaagaactttgcgggcgaaaacggaatgattaaggtggaagacataaacaagctaccgtatctacaagcggtgctcaaggaaacaatgaggatgaaaccaattgcgccattagcaattcctcataaggctgtgagagagacatctttggctgggaacaaagtagaaccagaaacccgtgttatggttaatatacacgcgattcatcataatccagaagtttggatggacccgtataaattcaagcctgagaggttcttgcaaggagaagatattaatggtggtggaaatttgaagttaatggagaattcattcttgccattcagtgctggaatgaggatttgtgcaggtatggaattgggtaagcttcactttggattttcacttgcaaatttggtgaatgcatttcaatgggattgtgctaagaaaggaaagctcccagatatgagtgatttgcttgggtttgtgctgttcatgaagacacctcttgaagcaaaaattgttcctcggggatcatcctccaatattaatggttattag

SEQ ID NO: 255 - DNA, 1473 bp, Corydalis chelanthifolia
atggaggagagtttttggattgtcagtgctacaatagtagtagtgtttgtcatagccacaatgttccgaaaatcatcaagcatatcatcgaaaaccgaatggcctgcaggtccaaaaaagctacctgtcattggaaaccttcatcaacttggaggagatgttttgcatgttgttttggcaaatcttgccaaggtttacggaactgtcatgacagtttgggttggcagctggaagccaatgatcgttattagcgatatcgatagagcttgggaagttcttgtcaacaaatccaacgactactcaggccgtgacttgccggaaatcacaaagatcatctcagcaaattggaagaatatcatgactgcagatgcaggtccttattggactagtctccgaaaaggacttacaggtcatacattggccccaacaaatgtagcatctcaaagccatctgcaggagaaagatatgaacaacttgattaacagaatgaaaaatcaagcagcttcaaacaatggaatcattaagccactcgatcatctcaaggaagaaacagttcgattgttgagtcgtctcattttcggacaacatttcgaggatgaacactttgtcgaaggtatacatcaagcgctcgatgatttggtacgtataagtggttatgctagtcttgctgatgcttttaagttttgtgaaaatctcccaagccataaaaaatctattagtggagttcatgaaatcttatccagagtaagaaaccttgtaaggccttacattgttccaaatcctcctacaaatacctatttacacttcctacaatcacaaaaattcaccgaggaagttataattgcttgtattttagaggtttatgatcttggtgttgatagtactgcagctacaactgtttgggcacttacctttttagtccgagaacccgaggttcaagagaaactataccgagaaatacaaacagttatcggagacaggggaacggtgaaggtcgaagatataagcaaaatgacatatctacaagcagtgatgaaggaaacaatgagaatgaaaccaattgcaccaatggccattcctcataaagctgtacgagaaacaactttgatgggaaacaaaatcgataagaacactgtcgttatggtcaatctttatgctattcatcacaaccctaaggttttccctgagccttacaagttcaggcctgagaggtttttggcaggcggagacggtaagtttgggaacttgaaggcaatggagcagtcacttttgccattcagtgctggtatgaggatctgtgcaggtatggaattgggtaagcttcaatatgggtttgctcttgctagtttggtgaatgcttttaactggacttgtactgctgatgggaaattgcctgacatgagtgaagatcattgcttcattttgttgatgaagaaccccctcgtagctcgaattattcctcgagtcaattaa

SEQ ID NO: 256 - DNA, 1488 bp, Chelidonium majus
atggaggagatcaatgtggaatggatctcaactgctgctactactattggtataatagtagtagtgtttgccacggtgtcgatgatgtttggtcgtcgaagaaaatcttcgatgaagtggccgaatgggccgaagacgttacctatcataggcaacatgcaccaacttggtgggactgcccttcaagttgttttgcacaagcttgccgatgtttatggtagcgttatgaccatctggatcggtagttggcgacccgtaattgttgttagcgacatcgacaaggcttgggaggttctcgttaataagtcgtctgattattcagctcgtgacatgcctgaaatcacgaggattaacactgcgaattggagtaccatctctacttctgattcgggaccccattggagtaacctcagaaagggtcttcagaatgtagcattgtcgcctcttaatgtagctgcccaaagtcagttccaagaaaaggatataaaccaagtgatcaagaatctacaagaggaatcagctctcaatggtggaattgttaagccgctcgatcatctcaagaaggcgacagtgaggctgcttagtcggtttatctacggtcaaaacttcgacgacgatacgtacgttgaaaatatgcacaatgagattgaagagctgatccgtattagtggttatgctcgtcttgccgaagcgttctattacgctaagtatctccctagccacaaaaaagttgagaaagctgtcgaagaagcccattacagagttaaagcattgattagtcctttcctcacaaggaatccccctccaaatagttacttgcattttcttcgctcgcaaaactaccctgaagaagtcatcatattttgcatctatgaagtgtacctgctaggggtcgacagtacttcctccacaaccgcgtgggcactcgcctatttggtacgtgaatcggcagttcaagagaagctctatcaagagctcaacaatttcatcggtgaccgtcagcagatggggtcggcaataaaggttgaagatgtaaataagttgcagtatctccaagcagtgatgaaggagacgatgagaatgaagccgatagcgcctttagcaatccctcacaaggcttgtaaagatacatcattaggtgggaacaaggtggataagggcactaaggttatggttaaccttcatgccatccatcacaacccaaaagtctggaatgaacctaacagattcaaaccagagaggttcttgcaattaaaagataaaaaagaaatggagcaatcatatctgccatttagtgcaggcatgaggacatgtgcagggatggagttgggcaagcttcagtttggttttgctcttgctaatctagtgtacgccttccagtggtcttgtgttgctgatgggaaacctcctgatatgagtgaccttctaggttttgttctcttcatgaaaaccccactcgaagcacgcatagttcctcgagtccgttga

SEQ ID NO: 257 - DNA, 1473 bp, Chelidonium majus
atggaggagagtttttggttggtagctgctactgttctagtagtctttgtagtagcaaaactactgttcaggaaatcatcttctatctctacaatggaatggccagcaggtccaaaaacactacccatcattggaaaccttcatcaattaggaggagcagctttacatgttgttttagcaaatcttgctaaagtttatggaagtgttatgacgatttgggtaggtgcttggcgcccgatgatcgtcataagcgacatcgacaaagcgtgggaagttcttgttaataaatcatctgattactctgctagaagtttgcctgaaattactagaatcatctctgcaaattggaagaacattatgacttctgattctggtcctttttggcaaaacctaagaaaaggtcttcaaggtggtgccttatctcctcataatgtcatgtctcaatatcaattgcaagagagagatatgcaaaatttgatcaagaccatgcgcgtcgaagcttctaaaaacaatgggagaataaaacctcttgatcatttgaagcaagagacggttcgattattgagtcgacttatcttcggccaagattttaatgatgagaaattggttgttggcatgcaccatgcgctcgacgatttagtacgtataagtgggtacgctagtcttgctgatgctttcaaagtcgctgaaaatttaccaagtcacaagaaatcgatccgcgaagttcacgaattgaagagacgcgtcgaaaacctggtacgcccacatatcgtttctaaccctcctaccaacacttacctaaattttcttctatctcaaaattttagtgaagatcttataatctctgcaattttagaagtttatgatttgggtgttgatagtactgcatcaacaactgtttgggcacttacatttttggtaagagaacaaaaagttcaagagaagctttatcaagaaatcaagaacttaactggtggaagatcaacagttaaggttgaagaagtaagtaagatgccctatttacaagctgtgatgaaagaaacaatgaggatgaaacccattgctccaatggctatccctcatacagctgcaagagagacttcattaatggggaagaaaattgataagggtacagtggtgatggtgaatctttatgctattcatcataaccctaatattttccctgagccctataagttcatgccagagagattcttgcatggtgaagaacaaaatggtggtaatattaaagaaatggagcaatcacttttgccatttagtgctggaatgagaatttgtgcagggatggaattagggaaacttcaattgggttttgcacttgcaagtttagtgaatgcatttaaatgggaatgtgctgctgatgggaaattgcctgatttgagtgaagatcattgttttattctcttgatgaagaatccacttgaagcaaaaattactcctcgcacccattaa

SEQ ID NO: 258 - DNA, 1506 bp, Chelidonium majus
atggagggtagtctgtggattatcctttccattttggttggagcagtgatgatactagttcaaaatttatggaagagatggtctaagacatcagaagacatgatattgccaccaggacctcggaagataccgatcatcggcaacttgtaccagctaaacaggggaggagaattgattcatgtggctttagctaaattagctcaagaacatgggaaaatgatgacgatttggttcggtggcgggcaaccatcgattgtggtgagtcatcatgaggtggcgtgggaggtgcttgtgaccaaggctgcagactattcatcgaggacccttccattcatgtctagggtaaccagtgcagactggcatactcttgctacctctaacttaggccccttttggcagacccttcgaaaaggtcttcgatccacaactcttaatccccatactatctctgctcaagtgcaactgcaggaggaagatgttaccagaatgatacttagcttcaaagaacaagcatgtttgaatgatggagttgtaaaaccattgatcccacttcgaagaaccacagttcagctcataggccgattttgttttggacctgaattcaagaacgatgatgattttgtcgaagaaatggatattgtgattgaggatgtgataagtctcactgggcatggacgtttgatcgatatatttgaattcactcgatacatccccggtctcaatcttcccttcaaacaagcctacaaagtgaagcagagaataatagaacttatacgcccgtatattgattaccacaaatcatcgaagtccccttgtcccaattgctacttacacttcctcctcagccatgactatgacgaagaagtgatcaccttcaatctcttcgagctgtttttgcttgcagtagatagcacgtcaaacgcaactgcttgggcacttgcgtatttgatacacgatcaaaaaatccaacagaaggtctatgatgaggttagcgaattcggccgaaaggaaatggttacaatagaagaggtgagcaagttaaaatatgtgaatgcagtagtgaaggagattatcaggatgaaaccaatagcacccctggctgtacctcaccaggcagatagggacagcaagttgatgggaattcaggtgaagaagggcacaccagttttggtgaatctctatgcgatgcactacgacccaagcatttggattgagccaagtagatttatgccggagaggttcttggttggtcatccacaaaatgttcattgtggtgaagatcatatggctgtcatggagaggtcattgattccgtttggtgcagggagacgaatctgtgcaggaatggatttggcaaagcttcaggtagctctaactatagcgaatttggtgaacagttttcagtggtcaagtgcggtagagggtcaactacctgacctcactgaggacctcacctttatactaaggatgaagacacctcttgcggcacgtataatacctcgttag

SEQ ID NO: 259 - DNA, 1464 bp, Cissampelos mucronata
atggatcaaaccaacatattgctcgccgtcgccgccgcgcttttcatcggattattgacgaagcttctcgcatcgaattccaagcatcatctccccccaggacccaaacctcttcccattatagggaacatgttggagcttagcaaaggtggggaactactccatgtctccctcgccaagctcgcggaaaggtacggcgaaatcatgtcattttggttcggtggtttcgagccctccattgttgtgacctcccacgagcttgtctgggaggtcatggtcaccaaggccaacgacttctccgatagagccctcccttggctcaccaagatcctcacctcgaactggcaaacgctcgcgacatgcgatctcggtccctattggtattccattcgaaagggtctccaatccacaacgctcaatcaccagaccataatgtctcaaacacaattgcaagagagagacatagccgatctcctcactagtctcgaacaggaggcctcgtccaacaatggaatagtgaagccatatcccatgcttcgaaaacttatggtacgcctagtctctaggttttgcttcggcccggattttcctaacgatgaagagttcgtcgagcggatggattccaccctcgacgagtcgattcaccaatccggacatactcggttagcggacttgttcgagttcactcgctacgttccaggcctctggggaccgtttaaggagtcggaaagtctgaagaggaggattgtcaaccttctaacgccgcacctaaaggcggcgtcgagtccaaattgctactctagtcttctcctctccaaggggttgagtgaagaggtagtagtcctcaacctctatgagttgttcgagctcgcggtggacgcaacgtcgaacacgaccgcgtgggctttggcgttcatcatccacaacaaagatgcacaagaaaaggtgttcaaggaggtgaggtataaccaagtgggtgagagaaggaaaataattagggttgaggagttgggggagatggagtatgtgcaggcagtggctaaggagacaattaggatgagacccattgcgccggtgatgccacacaaggcggcgcgggacggggagttgaagggcgttaaagtgaggggagggacgccggttttgatgaacttttacgcggtgcttcacgacgagaaagtgtggagggaaccgtacaagtttacgccggagaggtttacgacgaagggcgtagacgcggaggcgatggagaggtcgtatgtgtcgttcggtgtggggagaaggtcatgcccggggatggagttggctaagatacaaattgcggtcacggtggcaaatttggtgaataggtttgagtggtgcagtgctgcggagggtgaactccctgacctgtccgagggcctcacttttgtgctcatgatgaagactcctctcgtggcacggattgtgcctcgatcgtattag

SEQ ID NO: 260 - DNA, 1509 bp, Cissampelos mucronata
atggatgtacactacagcactctgttgatcgctttggccactctggcctctctcctactgctctcaaaactgctcctccgttccataaacaccagcaagcaccaccaatggccacccggacccaataaactccccctcattggcaaccttcaccagttccgcggagacctcctccatcagaacttcgccgagttagcccaaaagtacggaaagctcatgaccgtgtggatcggctctcaacaacccttcattgtggtcaccgaccccgacctcgcttgggaggtcttggtcaccagggccgtcgattactggtcccgccaaatgctttacttgtccaggattattagcgccggcaaccgaacgctggccacttccgacgggggaccctactgggagacacttcgaaggggtctacaatccactgctctaagcccccaaaccatctcctctcaaaccaaactgcaagagcaagacattgctcacatgatcgctagtcttcaacaagaggcttctttgaatgatgggcttgtcaagcctcttccccatattcgaaagctcgcgatacgcctcctcgcccgcttgtgcttcggggccgattttcctaacgacgagcactttgtggagcgaatggatgagctgttagaggatgacatgaggcttttgacggcggccggtttggtggatgtattcgagttcacccgccacattcctggactaactcctcgtcttaaggaaattgaggatcacatggaggggatcaaggggcttattcgtccttgcctcgctgctgcgatgaagaagaagggcaactcaatatctttggggaacacccacatgaacttcctcatttctcaagggttcactgaagaaatcattatacttaatctattcgaagtattcgttttcggagtcgatagcacttccatctccctttcatgggctctagggttcttaattgatggaagggaaacccaagagaaggtgctcaaggaaatagtgagcaaattgggagggagtaggagagtggttggagtgggggacgtgagtgggatggagtacgtgcatgcggtggtgaaggagacgttgaggatgaggccggtggcgccgatggcagtgccgcataaggcggcaagagatagcgagttaatgggatttaaagtgaaggaagggacaccattcttcgtgaatttgtacgcgttgcatcacaatgagaaagcgtggaaggacgctaataagtttgtcgcggagaggtttgtgaagggagacggagcggaggagtacttgaagaagatggagaggtactacatcccgttcggcgccggaaggcgggcttgtccggggatggagcttgccaaggttcacctcgcgatggtggtggccaatttggtgaacagtttcgagtggcaaagcgcggtggaaggccagccccttgacttatctgagactttgaatcctctgcttgttatgaagactcctcttgtggcacgtttagttccccgtttcgcttaa

SEQ ID NO: 261 - DNA, 1488 bp, EcCYP719-1
atggaggagatgaagattttgatgatgaataacccatggattcttactgctacagctacaactctactcatttccatcttcttgtttttcacaagaaaatcatcaaaaatggtttggccggccggccctaaaaccttacccatcattggaaatatgcatcttcttggtggaactgcacttcaagttgtcttacataaccttgccaaagttcatggcagcgttatgacaatttggattggaagttggagacctgttatcgttgtttccgacatcgagcgggcttgggaagtcctcgttaacaaatcatcggactactcggcccgtgacatgcctgatattaccaagattatttctgcagattggaaaacaatttcaacttctgattctggtcctcactggactaatttaagaaaaggtcttcaaaatgtagctttatcacctcacaatcttgcagctcaatttcaattccaagagaaagatatgactaaaatgattcaaactcttgaagaagaagcaagaaacaacaatgggattgttaaaccacttgatcatatgaagaaagctaccctaagattaataagtagattagttttcggtcaagattttaataacgataagtacgtagacgatatgcatcttgctatcgaagaattgatccgggtaagtggttatgctcgtctagccgaagctttttactatgcgaagtacttacctagtcataaaaaagccgttcgagaagtagaagaagctcagcgaagagttcaaaacttggtaagtccatttctttcgttaaatcctcctactaatacttacttacattttcttcgatcccaaaaatacgacgatgaagtcattattttcgctatattcgaagcttatcttttgggtgtggatagtacttctttaactacagcatgggcacttgcatttttaataagagaaccaaatgttcaagaaaaactttaccaagaacttgagagtttcgcatccaaaaatgatagaaagatcttgaaagttgaagatataaacaagttacaatatttgcaagctgtgattaaagagacaatgaggatgaaacctattgctccactagcaattcctcataaagcttgtagagatacttcattaatggggaagaaaattgataaaggaactagggttatggttaatatatttgctttacaccataacaagaatgtttttaatgatccattcaagtttatgcctgagagattcatgaaagttgatagtcaagatgctaatgggaaagcaatggagcaatcacttttgccatttagtgcaggtatgagaatttgtgcaggaatggagttaggaaaacttcaatttagttttgcacttgctaatcttgcctatgcatttaaatggtcttgtgttgctgatggtgttcttcctgacatgagtgatcaattagggtttgttcttttgatgaagaccccactcgaagctcgaattaatcgtcgtaattaa

SEQ ID NO: 262 - DNA, 1488 bp, Eschscholzia californica
atggaggaaattaaaatcttgattatgaataacccatggattcttactgctacagctacaactttactcatttccatgttcttatttttcacaagaaaatcatcaaaaatggtgtggcctcaaggaccaaaaaccttacccatcattggaaatatgcatcttttgggtggaactgcacttcaagttgtcttacataaccttgctaaagttcatggaagtgttatgacaatttggataggaagttggagaccagttatcgttgtttctgacatcgaaagagcttgggaagttctcgtgaacaaatcttcagactactctgctcgagagcttccagatattataaagtataacactgcagattgcaggacgatcgcaacttgtgattctggtcctcattggagtaacctaagaaaaggtcttcaaaatgtagctttatcaccaaacaatcttgcagctcaatttcaattccaagagaaagatgtaataaaaatgattgacattcttgaacaagaagcaataaacaagaatggaatagttaaaccacttgaccacttgaagaaagctaccattagattaataagtcgattagttttcggtcaagatttcaatgacgacaagtacgtagaagatctgcatcaagcaattgaagaattaataagaatgagtggttatgctcaacttgcagaagctttttactacgctaagtatttaccaagtcacaaaaaagctattcgacatgccgaattaactaaacaaatagttacaaacttggtacgtccatttctttcattaaaccctcctactaatagttacttacattttcttcaatctcaaaagtacgacgaagaaatggtcatttttgcaatctttgaaacttaccttttgggtgtggatagtacttcttcaactacagcatgggcactcgcgtatttagtacgagaaccaaatgttcaagacagactttataatgaacttaataattatgcaaaatataatgaccgaaagattttgaaagttgaagatattaacaagttacagtatttacaagctgtgactaaagagacaatgaggatgaaaccaatagcaccattagcaattcctcataaagcttgtagggacacttcattgatggggacgaaaatcgataagggtactaaggttatggttaatcttcatgctttacaccataatgaaaatgtttttactgatccattcaagttcatgcctgagagattcttgaaagttaataatgaagatgttaatatgaaagcaatggagcaatcacttttaccatttagtgctggtatgagaatttgtgcaggaatggagttgggaaaacttcagtttagttttgcacttgctaatcttatttttgcatttaaatggtcttgtgttgatgatggtgttcttcctgatatgagtgatgaattaggttttgttcttttaatgaagaccccactaaaagctcgaatcaatcctcgtaactaa

SEQ ID NO: 263 - DNA, 1473 bp, Eschscholzia californica
atggaggaaagcctttgggtagtcacagctacagttgtagtagtatttgcaatagcaaaattattgaagaaatcatcttctatctcaacaatggaatggccaaaaggtcccaaaaaactacccataattggaaaccttcatcaactaggtggagaagcatttcatgttgttttggctaatctagcaaaaattcatggaactgtcatgacaatttgggtaggggcttggagaccgatgatcgtcataagtgacattgataaagcttgggaagttcttgttaacaaatcatcagattatgcaggaagagattttcctgaaattacaaagatcatttcagcaaattggaaaaatatctcatgttctgattctggtccattttggcaaaacctaagaaaaggacttcaaggtggtgcattagctccattaaatgttatatctcaatatcaattacaagagagagacatgaaaaatttaatcacatccatgcaagaaaaagcatcaaaaaacaatggtattttgaagcctcttgattatcttaaagaagagacaattcggttacttagccgtctcattttcggtcaaagttttaacgacgaaaactttgttaaaggtgtgcatcttgctcttgacgatttggtacgtataagtggatatgctagtcttgcggacgcgttcaaattttgtgaaaatttaccaagtcacaagaaatcaattagagaagttcatgaagtgaatgaaagagttgttaacttggtaaaaccctatcttgttaaaaaccctcctacaaatacttacttatatttcttgaactctcaaaagtttagtgatgaagttataatttctgcggttytagaagtttatgatcttggtgttgatagtactgcatcaaccgcagtatgggcattaacatttttagtacgtgaacctcgtgttcaagagaaactgtataaagaaatcatagacttaacaggtggagaaagatcggtgaaagtggaggatgtgagcaagttgccgtatttacaggccgtgatgaaggagacaatgaggatgaaacccattgctccaatggcgattccccataagacttcaagagatacctcattgatggggaagaaagttaataagggtacaagtataatggtgaatctttatgctattcatcataaccctaaagtttttcctgaaccatataagtttataccagagagattcttacaaggacaagagagtaagtatggagatattaaggaaatggagcaatcacttttgccatttagtgctggaatgagaatttgtgcaggaatggaattggggaaacttcaatatggatttagtttggcaagtctagtggaagcatttaagtggacttgtgctgttgatggaaaattgcctgatcttagtgaggatcattgctttattttgttaatgaagaacccacttgaagcaagaattactcctcgcacccaattgtag

SEQ ID NO: 264 - DNA, 1488 bp, Eschscholzia californica
atggaggagatgaagttcttgataatgaataacccatgggttctttttgctacatctgctactctactcatttctatattcttgtttttcagaagaaaatcacccaacatggcctggccggaaggacctaaaaccttacccatcattggaaatatgcatcttttgggcggaactgcacttcaagttgttctatacaaccttgctaaagttcatggcagagtcatgacgatttggatcggaagttggagacctgttatcgttgtttccgacatcgaacaggcttgggaagttctcgtaaacaaatcatccgactactcagcccgtgacatgccggatattactaagattgtcactgcagattggagaacaatctcaacttctgattcaggacctcattggagtaatcttagaaaaggtctccaaaacatagctatatcccctaataatcttgcagctcaatttcaattccaagagaaagatataatcaaaatgattcaaattcttcaacaagaagccaaagacaataatggaattgtcaaaccacttgatcatctaaagaaagctaccattagattaataagtcgattagtatttggacgcgatttcgaagaagataagtatgtagaagatatgcatcatgctatagaagaattgattcgaataagtggttatgctcgtctagcagaggctttctattatgctaagtatttaccaagtcatagaaaagctgttcgatatgtcgaagaattaaaacaaattgttaaaaacctgatacgtccatttctttcactaaaccctcctactaatacttacttacattttcttcgatcccaaaattacgacgaagaagtcgttatttttgcaatctttgaaacttatcttctgggtgtggatagtacttcttcaactactgcatggtcacttgcatatttagtacgagaacccaatgttcaagatagacttcatcaagaactcgatcattttgcaaaacaaaacgatcgaaagatcttgaaagttgaagacatgaacaagttacagtacttacaagctgttatcaaagagaccatgaggatgaaaccaattgcaccattagcaattccacataaagcttgtaaggatacttcactgatggggaacaaaattaataagggtactagggttatggttaatctttatgccttacaccataacaagaatgtttttaatgatccttttaagttcatgcctgagaggttcttgaaagttgataatcaagatgctaaagggaaagcaatggagcaatcacttttgccattcagtgcaggtatgagaatttgtgcaggaatggagttgggaaaacttcagtttagttttgcacttgctaatcttatttttgcatttaaatggtcttgtgttgatgatggtgttcttcctgatatgagtgatgaattaggttttgttcttttaatgaagaccccactgaaagctcgaatcaatcctcgtaactaa

SEQ ID NO: 265 - DNA, 1515 bp, Glaucium flavum
atggaaatgaaaagctcagtggttttcagctacccagcaatggaggaactcttcaagagtaatccatgggtcattactggtactacacttgcagtattgattctcatgacgacgatgtttcgaaagaaatcgttgtcgatgaaatggcctaaggggccaaaaacgttacctatcataggtaacatgcaccttcttggtggcaccaatcttcaagtcatcttacataacatgtccaaagtttatggcaacgttatgactatatggatcggtagctggagacctgttatcgttgtttccgacatcgaacgagcttgggaagttcttgtgaacaagtcttctgattattcgggtcgtgacatgcccgaaatcaccaagatcatctcggctgattggaaaacaatttcaacttctgattccggacctcattggactaatctccgaaagggtctccaaaatgtggctttgtcgcctcacaatctcgctgcccaatttcaattccaagagcgtgatatatgcaaattgattgaaactctgaaagaagaagcgaagctcaacaacggaatcgttaaaccactagatcatctcaagaaggcgacaattagattaatcagtcgattagtcttcggtcaagatttcgataacagtaagtatgtcgaagatatgcaccatgccatcgaagaattaatccgtgttagtggttatgctcgtctagcagatgcattttattatgctaagtacttaccgagtcagaaaaaggcggtgagagacgtcgaggaagcgcaacgaagggtccaacgcttggtacgcccatttctttcattgaacccgcctactaactgttacttacattttcttagatctcaaaactactcagacgaagtcatcatatttgcaatctttgaagcttaccttttgggtgtggatagtacttcttcaactacggcgtgggcattagcattcttggtgcgtgaacctaatgttcaagagaagctttaccaagaacttaagaattttacggcgaaaaatggccgcgagatgttgaaagttgaagatataaacaagttgccatatttacaagctgtgattaaagagaccatgaggatgaaacccattgcaccattagctattcctcacaaggcttgtagagacacttcactaaaggggagaaaaattgataagggcactcaaataatggttaatatctatgcattgcatcataatgagaatgtttggaaggagccatttaaatttatgcctgagagatttttgcaaactgatcaggatgttaatgggaaagcaatggaccaatcactattgccattcagtgcaggtatgaggatttgtgcaggaatggagttggggaaacttcagtttagtttttcacttgctaatcttcttaatacttttcaatggtcttgtgttgctgatggggtacttcctgacatgagtgatcaacttgggtttgttcttttgatgaagaccccgctcgaagcgcggattactcctcgttgctag

SEQ ID NO: 266 - DNA, 1473 bp, Glaucium flavum
atggtggaaatcagtgtgcagtggatcctaactactagtgtagtagtactagtttttgccattgcttcgaagatgttcgctaatggaagaaaatcttcgatgaaatggccggaaggaccgaagacgttaccggtcataggcaacatgcaccaacttgggggaactgctcttcaagttgttttgcataagcttgctgatgtttatggcagcgtcatgaccatatggattggtagttggcgacctgtaattgttgttagcgacatcgacagagcttgggaggttctcgttaacaagtcatctgattattcagctagagaaatgcctgaaatcaccagaattaatactgcgaattggagaaccatctctacttctgactcaggacctcattggagtaacctccgcaagggccttcagaatgtagcattgtctcctctcaatgttgctgctcaaagtcagttccaagagagggatataaaccaagtgatcaaggatttacaggaagaagcggctctgaacaatggaatcgttaagccacttgatcatctcaagaaggcaacggtgagactacttagtcggttcatctacggacaaaacttccatgatgataagtatgttgaatctatgcactatgagattgaagagctgatccgtattagtggttatgctcgtcttgctgaagctttctactacgccaagtatcttcctagccacaaaaaacttgagaaagccgtcgaagaagcccattacagagttaaagcattgataagtcctctcctcacaagtgatcctcctcctaatagttacttgcattttcttctctcacaaaaccaccccgaagaggtcatcatattttgcatatatgaagtgtatcttctaggggttgacagtacttcctccacaaccgcgtgggcgctcgcctttttggtacgtgaaccagccgttcaagagaagctctaccaagagctcagcaattttgtcggtgaccgtcagcaaatggggtgtgctgtgaaagttgaagatgtaaataagctgcagtatctgcaagctgtgatgaaggagacaatgagaatgaagccgattgcgcctttagcaattcctcacaaggcttgtaaagatacatcattgggtgggaacaaggttgataaggggactagagttatggttaaccttcatgctttacatcacaacccaaaagtctggaaagaacctaacacattcaaaccagagaggttcttggaactaaaagataaggaaatggaacaatcatttctaccatttagtgcaggtatgagaacttgtgcagggatggaattggggaagcttcagtttggttttgcacttgctaatctagtgaatgccttccaatggacttgtgttgctgatggaaagcttcctgatatgagtgacctattaggatttgtcctcttcatgaagacacctcttgaagcacgcatagttcctcgtgtccgttga

SEQ ID NO: 267 - DNA, 1503 bp, Glaucium flavum
atgggtcggttcttggcgcccgatatagagatggaggagagtttttggttagtaacagctactgttatagtagtgtttgcagtagcaaaatttttcaccagatcatcttcaatctctaaaatggaatggccagcaggtccaaaaaaactacccataattggaaacctacatcagcttggaggaaatgtcttccatgttgttttagcaaaccttgctaaagttcatggaagtgttatgacaatatgggtcggttcttggcgcccgatgatcgtcataagcgatatcgagaaagcttgggaaatgcttgttactaaatcatctgattattcaggtagaagtttccccgaaatcacaaagatcatctcagcaaattggaagaacatttcttgttctgattctggtcctttttggactaacctaaggaaaggtcttcaaggtggtgctttagctcctcttaatgtcatctctcaatatcatttacaagagaaagacatggaaaacttggtcaaatccatgcgcgtcgaagcttcgaaaaacaatggaaatataaaaccacttgatcatcttaagcaagagacggttcgattattgagtcgacttattttcggccaagattttcatgatgagaaattggttgtcggcatgcaccacgcgctcgacgatttagtacgtataagtgggtatgcaagtctcgccgacgctttcaaaattgctgaaaatctacctagtcacaagaaatcgatacgtgaggttcacgaagtgaacgaacgcgtcaaaaaattggtacgtccacatatcgtctcgaaccctcctactaacacttatctatattttcttcaatcccaaaaatttagtgaagatgttataatctctgctattttagaagtttatgatttgggtgtagatagtactgcatcaacaactgtttgggcacttacatttttggtaagagaacaagagattcaagaaaagctttatcaagaaatcaaaagtgtaagtggtggtagatcaacagttaaggttgaagaagtaagtaagatgccttacttacaagctgtgatgaaggaatcaatgaggatgaaacccatagcaccaatggcaattcctcataaggcacaaagagaaacaacattaatggggaagaaagttgataaggacactgtactaatggtgaatctttatgcaattcatcataaccctaatgtttttccggagccatttaagttcatgccagagagattcttgcaaggggaagatcatcacaatggtggtaatattaaagccatggagcaatcacttttaccatttagtgctggtatgagaatttgtgcagggatggaattagggaaacttcaattggcttatggacttgcaagtttggtgaatgcatttaaatgggattgtgctgttgatgggaaattgcctgatatgagtgaagatcattgctttattctcttgatgaagaacccacttgaagcaagaattactcctcgcacccattaa

SEQ ID NO: 268 - DNA, 1479 bp, Hydrastis canadensis
atggcagaaattgagttgggtctatggcttgggggtgctgttgtggccatagtcttgtccaccatattatttcgatcatcttcatcatcttcatctttttcgtcacagacaaaatggccggctggtccaaaaaaattacctattataggtaatatgcatcaactaggcggcgacgtgcttcatgtggccttagacaagttatctaaaattcatggtggtgtgttcacattttggattggtagttggagaccagttattgtgattagtgatattgataaggcatgggaagttcttgtgaataagtcttcagactattcagcgcgcgatatgcctgaaattactaaaataggctcagcaagttggcacacaatttctacctctgatcctggtcctttttggcaaaatgttcgtaagggacttcaaggtggtgctatgggtcctctcaatatgtctgctcaaactccattccaagaaaaagacatgaagaatctgattgaaaccatgaaaattgaagctgaaaacaacaatggaatcatcaagccacttgatcatataaaaaagaacactgtaaggttacttagtcgtcttattttcggacaaatgttcgaagatgacaagtttattgaatcaatgcattatgaaatcgaagatattattcgtataagcggctacgctcgtcttgccgaggccttttattatgctaaatatcttcctagtcacaaaagagctgaaaaagaggcatttctagtcaagtgtagagttgaagacttggtaaggccacttctcaaatcaaatcctccttcaaatagctacttatacttccttctttcacaaaattacccagaagaagttatcatattttgcatatttgaattgtatcttcttggagttgatagtacttcttctactacaacatgggcactcgcgtatttgattcgcgaacaagctgttcaagagaagctttatcaagatatcaaagttacaattgggaacgcgaatcttgtcaaggttgaagatgtgaacaaattgaagtacttacaaggggttgttaaagaaaccatgagaatgaaaccaatagcacctttagctattcctcataaatcttctaaagatactacattgatgggtactaaggttgctaaaggaacaagacttatggttaatctttacgcgttgcatcataatcaaaacatatggtctgaacccttcaaattcatgcctgagagattcttagaagatggaaataataacaaagcaatggaacagtcatttcttccatttagtgctggaatgagaatttgtgcaggtatggatttgggtaagcttcaatttgcttttgctcttgctaatcttgttaatgctttcaaatggtcttgtgttgaagaaggtaagtttcctgatatgagtgaagaattctcttttgttcttctgatgaaaaacccacttgaagcgcgaatcactcctcgaaaagctcattga

SEQ ID NO: 269 - DNA, 1398 bp, Jeffersonia diphylla
atgacaaagtcgtcttcgtcatggtcgacaatgaaatggccagcgggcccaaaaacactacccatcattgggaacttacaccaactccagggagacatcttccacaaggctttggcgaagcttgctggagtgcacggtggcgtaatgactatctggcttggaagttggagccctgttatagttgtcagtgacattgatcacgtttgggaagtattagtgagcaagtcttttgattactccgcacgaccaaagccagatctcatcaaaatagtagctggggacgatattaacatttccgactctggcactttttggtataatcttcggaagggcctccagaatgtcccgctgggaccagtcaatatctgtgcgcaaaccaattaccaggaaggagatattgaacaaatgattggtgatatgcaggaagaagcaagtagcaatggcggaatagtgaaaccactctaccatcttaagagagcctcaacgagattactgtgtaggctcattttcggacacacattccatgatgactcgtttgttgagtctataaacaatgctgttgaaaagatgattcgtttaggtgagaacgttcatcttgcagaagctttctcatatactaaatacttgcctagtcacaaacgtgctgtcagaagaagttacgaactaaaacttgcaatccaagagttggtgcgaccgtttctagtttcaactccccctcctaatacttacttgtactttctactctctcaacaccaccctgaagaggtgatcatatcttgcatctttgagttgtttgttttaggcgtggatagtacttcttctaccacaacatgggctctggctttcttgatacatgatcaggtagttcaggagaagctctatcaagaaatcatacaagtaagtaatggtgattgtcttctgagaagcaaagatttaagtaagatgcaatatttgcaagcagtgatgaaagaaactatgagaatgaaaccaattgctcctcttgcaatccctcacataacttctaaacacactacactaatgggaactaaggtggctaaaggaacatcagtcatagttaacctttatgccttacatcataaccccaacatctgggttgacccatacaaatttatgcctcacaggttcttgcaaggacaagatgatgtgaatgttaaagcaatggaacagtcctttctaccgttcagtggagggatgagaatttgtgcaggaatggaattggccaagcttcagttttctttagcactcgcaaatcttgtccgtacgtttaaatggaccactgttttggatggcaatctcccagatatgagtgaggagttgtcatttatcacactcatgaagacaccacttgaagcacggatcatctgtcgccaccattga

SEQ ID NO: 270 - DNA, 1470 bp, Mahonia aquifolium
atggagttcactgtatgggttgtgagttttaatgtccttgtagtggtagccatgtcaatgttcttactcagaacaaagtcatcttcctccacaacaaaatggcctattgggcctaagaaactacccatcataggtaacttgcatctactcggaggcgacgtgctccacgttgctttagcgaagctcgctaaagtgcatggtggcataatgactatctggattggaagttggcgaccagttattgtcgtcagtgacatcgacaaagcttgggaggtgcttgttaacaagtcctcagactactctgctcgtgacatgcctgagattaccaaaattgcctcagcaagctggcacactatctccagttccgactccggcccattttggcaaaacctccgtaaaggcctccagaatggagccttgggcccggctaacatctcagcacaaagccaactccaggaaagagacatcaagagaatgattggagacttgcaaaaggaggccaagatcaatggtggaattgttaaaccacttgatcatattaagaaggccgctgttaggctactgagtcgcctcatcttcgggcacacgttcgatgatgattcatttattgaatccatgcaccatgagattgaagatctcattcgcataagtggctatgcccgtcttgcagaagccttctcctatgctaaatacctccctagccataagctggccgttaaagaagcgtatgaagtgaaacacagagttgagcaactggttcgaccacttctcacttcaagccctcctgcaaatagttacctaaacttcctcctctcacaagattactcagaagaagtgattaccttttgcatctttgagatatatctattaggtgttgatagtacttcatctaccacaacatgggccctttcttacttgatacatgaacaacaagttcaagagaagctctatcaaagcatcaaaggagtcacctcagatgatgacggccttgtgaaagcggaagacttaagtaagttacaatacttacaagcagtgatgaaggagacaatgagaatcaaaccaatagcaccattggcaatcccacacaaggcttctaaagacaccaaattgatgggtactaaggtagcgaaaggaacgcgtgtcatggtgaacctttatgctttacatactaaggaaaacatatggtctgatccagagaagttcaagcctgagaggttcttgcatggagatgaaggtgttaatgtgaaggcaatggaacaatgttttttaccattcagtgcaggtatgagaatctgtgcaggtatggagttgggaaagcttcagttttcaattgcacttgctaatttggtgaaagctttcaagtggacaagtgttgtggatggggagctcccagatatgagtgaagaactgtcttttgttctactaatgaaaactccacttgaagcaaggatcattccaagggacctttga

SEQ ID NO: 271 - DNA, 1498 bp, Menispermum canadense
atgggggagggtagtctgtggatcgtagcaaccacattggttatggttggagtgttgatctttatgatggagcaatccttgttgtggaggaggagatccacgcagaagtggccaccaggacccacaaagttccccttcataggaaacttgtaccagctcaacaagggaggagaactggttcatgtcaccctcaccaagatggcccaacagtatggcagaatcatgactatttggtttggaagccaagaacccacgattgtggtgagcgatcacgagctagcttgggaggttctagtgaccaagtcctctgactactcatccagaacactgccttacctgtccagggtcactagcgccgacttccacacgctagcgacctgcgacttaggcccatattggcaaactcttcgaaagggccttcaagccttcaccattaatccccacaacatatcttcgcaaatccatttgcaggagaaagacatagccgatttggtcctcagccttgaagaagaagcctctttgaacaacggtgtcgtcgacccactgcccaaactccgaagacttttaatacttctcatccgtcgattctgcttcgggcctgatcgtgaattcaacgacgacctctttgtggaaagaatggactgcgctttggaggacgtgataaggctctttggtcacgctcgcctcatcgatgtgttcgaattcgctcggtacattccgggtatcgggctaggtccatttcaagaagtaaagcgtttgaaacagaggataaaggagctgattaggccttacatcttggctcacaaatcgtccaactcagcttgtcaaaattgtcacttgaacttcctactctcgcaggggttcaccgaagacgtcgtgatcttgaatctgttcgagctgttcatgctcggagttgacagcacctccgctgcaatcgcgtgggctcttgctttcgtgatacatgaagaagaaactcaacaaaagctggtagacgaggtgatcaacaaattggggagaggacgaagaatggtgggagtagaggaggtgagtgagttggaatatgtgcaggcggtggtgaaggaaacaatgaggatgaaaccgatagcaccgttgccagtgcctcacagggcagtgagggatagcgagttgaaggggacgaaggtgagagaagggacgcaagtgttggtgaatttgtacgctgtgcttactgatgggagggtgtggaaggaaccgaatcgattcatgccaaagaggtttctgcagagtcagagaggagaagatatgagagcaatgataatggggatggagagatctttcattccatttggtgcgggaagaaggatttgtgcaggaatggagttggcaaagcctcaagtggctctcactctagccaatttggtttacaagtttcaatggtgctctgaggttgaaggtcaactccctgatttgtcggaggatcttacttttgttctcaggatgaagactcctcttgtggcac

SEQ ID NO: 272 - DNA, 1491 bp, Nandina domestica
atggatcccatgagtctatgggctgcgattgccattgtcttggtgatgactttgttggtgttattacaaacacgaaccaagtcattaccgtcttcctccactcaatggccaactggtccaaaaacacttcccataatcggcaacttgcaccaactagaaggcgatgtttttcatgtggctttagcaaagcttgctaaaatgcatggtgatattatgactatctggattggaagttggcggccagtcattgttataagtgattacgataaagcttgggaggttttggtgaacaaatcctctgattactctgcccgtgacatgcctgaaattaccaagattgcctctgcaggttggcgtactatctctttatctagttctggaccattttggcatacccttcgcaagggtctccagaatggtccttttggtccactcaatgtatcagcacaaattctttctcaagagagagacatgagacgaatgattcgtgacatgcaagaagaagccgacatcaatggaggaattgttaaaccacttggccatcttaagaaggccactgttgggttactaactcgacttatctttggacaaaactttgatgatgattcatttatagagtccattcaccatgaaactgaggaacttattcgtataagtggttacgctcgtcttgctgaagccttctcgtatgctaaatatcttcctagtcatagacgtgctgtcaaagaatcatatgaatgtaaacatagagtggaagaattggtgaaacctctactttcatcaaatcctcccaaaaatagctacttgaactttcttcagtcacaagattatcctgaggaagttatcatattttgcatctttgagatatatctcttaggtgtggatagtacttcgtcgaccactacatgggctcttgctttcttgatacatgaaccagctgtccaggagaaactctatcaagaagtcaaatgcataactaatggtgatggggggcttgtgaaggccggagatctaagtaagtttcaatatctgcaagcagtgatgaaagagacaatgagaatgaagccaatagcacctttggcaatccctcacaccacttctaaagacactactttaatggggactaaggtcgccaaagggacacgcatcatggtaaacctttatgccttacatcataacccaaacatatggagtgagccatttaagtttatgcctgaaaggttcttgcaagaacaattcaatggtgttggtggtgatgctaatgtaaaagctatagaacaatcgtttctaccatttagtgcaggtatgagaatttgcgcaggtatggatttgggaaagcttcagttttcttttgcacttgcaaatctggtgaatgcatttaaatggactactgttgcggacggtaaattcccggacatgaatgaggaattgtcattcgttctcttaatgaagaccccacttgaagcgcgaattgttcctcgtaagccatga

SEQ ID NO: 273 - DNA, 1494 bp, Nandina domestica
atggaagccatwagtctatggacagttagtgccagtttcttgacactgttggccttggcaatcatattaccaagaacaagaaactcctcttccataatcaactggccacctggtccaaaaactctacccatcatcggtaacctgcaccaactaggagggcaacttttgcatgtagctttgacgaacctcgctaaagtgcacggtggagtgatgacaatctggatcgggagttggcgacccataattgttatcagtagccctgaggaagtttgggaggtgcttgtgaaaaagtcacctgactatgccgcacgcgatatgccagaaattaccaaattaatcactggatattggcatacaattagcagttctcactctggccaattttggagtaaccttcgcaaaggtctccaaaatggtccattaggaccactcaatatcaccacccaaatgagtttccaagagaggaacatcaaaagaatgatttctgacattcaagaagaagcaacatttaatggtggaatcgtgaagccactagaacatcttaagaaagccacactgaggttactaagtcacattatctttggacaaagttttgatgatgatcagtttattgattccatgcaccatcagattgaagagttgattcgtataaatggtttcgctcctctggttgatgccttttcatatgctaaatacctccctagccataaacgagccatcaaagaaacataccgtgtaaaaaatcaaatcgaacaactagtgcgacctgttatagcttcaagtccccctgcaaattgttacttacactttcttctctctcaaggttactctgaagaggtggtcatatatagcatagtagaattgtactccttaggtgtggacagtactgcttctacaactacatgggcactcgctttcttgatacatgatcaaacagtccaggataagctttaccaagatatcaaacatatagctgctaccgatgctcttgtcaaaatagaagatttaagtgcgttgcattatttagaagctgtgatgaaagaaactatgagaatgaagccaatagcacctttggcaatccctcacaaaacttctaaagatactacagtaagggggactaaagtggctgcaggaacatgtgtcctggtaaacctttatgccttacatcatgaccacaaaatctgggctaagccacacaaatttatgcccgaaaggttcttggaaggaaatgttaatggtggtgatagcagtggagccaatgtcaaagtgatcgaacagtcgtttctgccatttggtgcaggaatgagaatttgtgcaggcatggaattagggaagctgcagttttcatttgcacttgctaacttggtgaatgcatttaagtggactagtgttgtcgatggtaagctcccagatatgagcgaggaactaaaattcattatgctcatgaagacacctcttgaagctcggatcattcctcgtaactccttgaattga

SEQ ID NO: 274 - DNA, 1470 bp, Papaver bracteatum
atgatcatgagtaactcttggattcttacgctcatttctaccatattatcagtcgtctttgctgctgtgttaatcattttcaggagaagaatatcagcatccacaacggaatggcctgttggcccaaaaacattaccgatcataggtaacttgcacattcttggaggcactgctctccatgtcgtcttacataaactagctgaagtttacggcagtgtaatgacgatatggattggtagttggaaacctgttattattgtttctgactttgatcgagcttgggaagttcttgttaacaaatcttcagattattcagctcgtgaaatgcctgagatcactaaaatcggcactgcaaattggagaacaatttcaagttctgattctggtccattttgggccactcttcgtaaaggtcttcagagtgtagcattatcccctcagcatttagcatcgcaaactgcacaccaagagagagatataataaagttgatcaaaaatttgaaagacgaagcagctcttaattctggaaccgttaaaccacttgatcatctcaagaaagcaactgttagattaatcagtcggttaatctttggtcaggattttgatgacgataagtatgttgaagatatgcatgacgtgatcgagtttttgattcgtattagtggttatgctcaacttgctgaggttttctactatgctaaatatctaccaagtcataagagagctgtaactggcgccgaagaagcaaaaagaagagtaatagctctggtgcgtccttttcttcagtcaaaccctgctacgaacacttacttgcattttcttaaatcgcagcactacccagaagaggttatcatattcgctatattcgaagcttatctattaggtgttgatagtacttcttcaaccactgcatgggcactcgcattcttaatacgtgaaccatctgttcaagagaaactttatcaagagcttaagaatttcacagccaataacaatcgcacaatgctgaaagtcgaagatgtcaacaaattaccatatttacaagctgttgttaaagaaacaatgaggatgaaaccaattgcaccactggcaattcctcataaagcttgtaaagacacttcattgatgggcaagaaagttgataagggaactaaagttatggttaacattcatgctttacatcatactgaaaaagtttggaaagaaccttacaaattcatgccagagaggtttctgcaaaaacaagataaggcgatggaacaatcactattaccattcagtgcaggtatgagaatttgtgcaggaatggaattaggaaaacttcaatttagtttttctcttgctaatcttgtatatgcttttaaatggtcttgtgtttctgatggagtgcttcctgacatgagtgatttactggggtttgttctgttcatgaaaaccccactcgaagcacgtgtagttcctcgtttgtag

SEQ ID NO: 275 - DNA, 1485 bp, Papaver bracteatum
atggaagagaactcctggttcataacagctactattactgtgatagtagtatttgtattagcaaaattcctagcttccaaaatattttctcccactacaatggaatggccagcaggtccaaaaacactacctataattgggaaccttcatcaattaaagggagatctctttcacgttgttttgcaaaatttagccaaagttcatggaggtgtttttacaatatggattggaagttggaatcctgttattatcgtaagcgatttcaacattgctcgcgaagttcttgtttctaaatctttggatttttcagctagaagtgtgcctgattatgtgaaaatcgtttcggcaggtgggaaaactatttctgaatccgattgtggtccattttggcatggtcttaggaaaggtctacagggtgttgcactaaaccctcttcatcttatgtctcagtctcatttacaagaaagggacatgcaaaatctaatcaaatccatgcaagaaagtgcatctcaagaggatggggttatccaacctcttgattatattagaaaagcgactattcggttactaagtcgaattttaatcggtcaagatttctcaaatgaagattttgttgattctatgaatcatacactccataaattagtatctataggtgggtttgcaagtttagctgatgcatttaaaattggagaatacttacccacccataaaaaatttattcgcgaacttaaggatgtaagtgaagaagctgcaaatctgattcttccatatatcgtatctaaaccttctaagaatacgtacttacattttcttgtatctcaagagtatagtgaagatgttatagtctctgctgtacttgaaatttttggcatgtcatcagatagtactgcagcagcaacagtttgggcactcgcttttttagtacgccatcctgacattcaggaaaagctttaccaggaaatcaagaacgttacgggtgggaatagacccgtacaaatcgtagatgtgaaaaaaatgccgtatttacaagcagtggtaaaagaaacgttaaggatgaaagccgttggtccaatgggaatttctcataaagcttcgaaaaacacgtcattaatggggaagaaaatcgacaagggtacacaagtgatggtcaatcattatgctattcatcacaactctgacattttcccggaaccgtataatttcaagccagagaggttcttcaaggatgttaatagtgatgcaagtttgggtgatcgcgaaaaaatggaaagttcattattaccatttggtgctggtatgagagtttgtgcaggtacagatatagccaaacttattatatcttttggaattgcaagtttggttaatgagttcaaatggagttgtgtttctgatggaaaactgcctgatctaagtgaagatcttagtttcattctcttgatgaaaaacccacttgaagctaggatcgctcctcgagttgattaa

SEQ ID NO: 276 - DNA, 1521 bp, Papaver bracteatum
atggctccgattaatatagaggagaatgatttttggatgatagcatgcactgtaataatagtatttgcattggtgaagttcatgttttctttttatcaatctgcaaatacgacggaatggccagaaggtccaaaaacactacccataattggaaaccttcatcagttgggaggaggtgttcccttacaggttgctttggcaaacttatccaaagtttatggaggtgcattcacaatttggattggaagctgggttccaatgatcgtcattagcgatatcgacaacgctcgggaagttcttgttaataaatctgctgattattccgctagagatgtacctgatattcttaaaatcatcacagcaaatgggaagaatattgctgattgtgattctggtccattttggcatcatttaaagaaaggtcttcaaagttgtataaatccatcaaatgttatgtctctatctcgtttacaggaaaaagacatgcaaaatctcatcaaatccatgcaagaaagagcgtcacagcagaatggaattttaaaacctcttgatcatgccaaagaagcgtctattcgattactgagtagagttatatttggtcaagacttttcaaatgaggatctcgttattggtgtgaaagacgccctcgatgagatggtacgcataagtgggttggcaagtttagctgatgctttcaaaattgctaaatatttaccaagccagagaaaaaatattcgggatatgtacgccacaagagacagagtatataatttgattcaaccacatatcgtctctaatcttcctgcaaattctttcttacattttcttacatctcaagattacagtgatgaaattatttactcaatggtacttgaaatttttggtttgggagtagatagtactgcagcaacggcagtttgggcactctcctttttagtcggcaagcaggaaattcaagaaaaactttaccgcgaaataaacaacctgacgggtgggcaaagaccagtgaaagttgcagatttgaaagagctgccatatctacaagccgtgatgaaagaaacattgaggatgaaacccatcgcaccactagcggtccctcatgtagcagtaaaagatactacattcaaggggaggagaatcgttaaaggtacaaaagtaatggtgaatctgtatgctattcatcacgaccctaacgttttccctgcaccgtataaattcataccagagagattcttaaaggatgttaatagtgatggacgttttggtgatatcaacacaatggaaagttcattgataccatttggtgctggtatgagaatttgtggaggtgtagaattagccaagcagatggtaggttttgctcttgcaagtatggtcaacgaattcaaatgggattgtgtttctgaggggaaattgcctgatcttagagaagctgttagcttcattctctacatgaaaaacccacttgaagccaaaattactcctcgagatgctcgatcgtacaaaacctttggacagtag

SEQ ID NO: 277 - DNA, 1491 bp, Sanguinaria canadensis
atggagttcgaaaaaataatgatgagtaatccatggatccttgctgctactacagcagtagtattcatttccatcactgcgattttcttccggagaaaatcgtcgtcgatggaatggccgacggggccgaaaacgttacctatcataggtaacatgcaccttctcggtggtactgctctccatgtcgtcttacataactttgccaaaatctacggcaacgttatgacgatatggatcggtagttggagaccagtgatcgtcgtttccgacatcgatcgagcttgggaagttctcgttaacaagtcatccgattattcagcccgcgacatgcctgaaatcactaagatcatttctgctgactggaaaacaatctcaacttctgattccggacctttttggactaatctccgaaaaggtcttcaaaatgtagctttatcgcctcataatttggctgctcaagctcggttccaagagcgtgatataagcaaaatgattgaaactttgaaagaagaggctgctctcaataatggaattgttaaaccacttgatcatcttaagaaggcgacggttaggttaatcagtcgattaatctacggtcaggaattcgataacaataagtacgttgaagatatgcatcatgccattgaagaattgattcgtgttagtggttacgctcgactggccgaagctttttattatgcaaagtatttaccaagtcataaaaaggcggtgagagacgtcgaagaagcgaatcggagagttaaaaatctggtacgtccatttctttcatccaatcctcctactaactgttacttacattttcttagaacccagaactacccagaagaagtcatcatatttgcaatctttgaagcttatcttctgggtgtggatagtacttcttcgactacagcgtgggcacttgcatttttagtacgtgaaccaaatgttcaagagaaactctatcaagaactcaagaatttcacgactaataatgaccgtaagatgttgaaagtcgaagatataaacaaattacaatatttacaagcagttatcaaagagacaatgaggatgaaacccattgcaccattagcaattcctcataaagcttgtaaagagacttcattgatggggagcaaagttgataaaggcactagggttatggttaatatctatgcattacatcataatcaaaaagtatggaaggagccctacaaattcatgccagagagattcttggaaacagataatcaagatggtaatgttgggaaggcaatggagcaatcactattgccatttagtgcagggatgaggatttgtgcaggaatggaattggggaaacttcagtttactttttcacttgctaatcttgttaatgcttttaaatggtcttgtgtttctgatggggtacttcctgatatgagtgatcaattagggtttgttcttttgatgaagaatccactcgaggctcggattgtacctcgatcgtag

SEQ ID NO: 278 - DNA, 1512 bp, Sanguinaria canadensis
atggaggagatgatcagtctgcaatggatcctaactgctgtgatagtagtagtagttgtcgccatggcgtcgaagattttcagcaatcgaagaaaatcttcgatgaaatggccggacgggccgaagacgttacccatcataggcaacatgcaccagcttggagggactgccggcctccaagttgtcttacataagcttgccgatgtttatggaagcattatgaccatctggatcggtagttggcgacctgtaattgttgtgagcgacatcgacaaggcgtgggaggttcttgttaacaagtcctcagattattcggctcgcgacatgcctgaaatcacgagaattaataccgcgaattggagaaccatctctacttccgactcaggacccttttggagtaacctccgaaagggtcttcagaatgtagccttgtctcctcacaatctggctgcccagagtcagttccaagagagggacataaatcgattgatcaaaaatctaaaagaagaagcggctctcaacgatggaatcgttaagccacttgatcatctcaagaaggccacagtgagactactgagtcggttgatctatggacaaaacttcaatgacgataagtatgttgaaactatgcacaatgagattgaagagctgatccgtattagtggttatgctcgtctcgccgaagctttctactacgccaagtatctccctagccacaaacgagttgagaaagcggtggaagaagcccattacagaattaaagcattgataagtcctttactctcatggaatcctcctcttaatagttacttgcacttccttcgttcgcaaaactaccccgaagaggtaatcattttttgtatctatgaagtgtatctcctaggggttgatagtacttcctctacaactgcgtgggcactcgcgtttttggtgcgtgaaccagcggttcaagagaagctctatcaagagctcaacaacttcacccatgatcgtcagatgtcggcggtgaaggttgaagatgtaaataagttgccgtatctacaagcggtgatgaaggagacgatgagaatgaagccaatagcccctttggcaattcctcacaaaacttgtaaagaaacttcattaggtgggaacaaggtggataagggaactagggttatggttaatctccatgccatacatcacaaccccaaagtctggcatgagccttacagattcctaccagagaggttcttgcaagtaaataaggaaactattaataatggtggtggtggtggtggtactgcgaaagaaatggagcaatcattcttaccatttagtgcaggaatgaggatttgtgcagggatggagttggggaagcttcagtttggtcttgctcttgctaatctagtgaatgccttccagtggtcttgtgttgctgatggaaaacttcctgatatgagtgacctactagggtttgttctctttatgaagaacccgctcgaagcacgcattgttcctcgtatccgttga

SEQ ID NO: 279 - DNA, 1458 bp, Sanguinaria canadensis
atggaggagagtttctggttagttactgtctctgtaattgtattatttgcagtggcaaaattcttcagaaaatcttcatccattcctaaaatggagtggccagcaggtccaaaaaagctacccataattggaaaccttcatcaacttggaggagatgtcttccatgtggttttagcaaatctggctaaagtttatggaagtgtcatgacaatttgggtgggctcgtggcggccgatgatcatcgtaagcgacatcgacaaagcgtgggaagtacttgttagcaaatcatctgattattcagctagagatatgcctgatataacaaaaattatatctgcaaattggaagaacatttcttgttctgattctggtcctttttggcataacctaagaaaaggtcttcaaggtggtgccctagctcctctcaatgtcatctctcaatatcacttacaagaaagagacatgcaaaacttgatcaattccatgcaacaagaagcttctaaaaacaatgggattctaaaaccacttgatcatcttaaacaagagacggttcgattacttagtcgactcattttcggccaagattttcacgacgagaaactagtcgttggcatgcaccatgcactcgacgatttagtacgtataagtgggtacgcaagtctagccgatgctttcaagttcgccgaaaacctacctagtcacaaaaaatctatacgagaagtccacgaagtgaaagaacgcgtcgaaaatttggtacgtccccatattatcccaaaccctcctactaacacttacttacattttcttcaatctcaaggatttagcgaagacatcgtaatctcgggtattttagaagtttatgatttgggggtcgatagtacagcgtcgacgacggtttgggcgcttacatttttagtgagagaacaaaaaattcaagaaaagctgtttgaagagataaaaaaagtaacaggtgggagatcatcagttagggttgaagaagtgagtaagatggcatatttacaagcagtgatgaaggagacaatgaggatgaaacccattgctccaatggcaattcctcataagacatcaaaagagacttcattaatggggaggaaagttgataaggggtcagtgataatggttaatctttatgcaattcatcataaccctgaagtttatcctgagccatataagttcaaaccagagaggtttttgcagggaagtgagaatattaaggcaatggagcaatcacttttaccatttagtgctggaatgagaatttgtgcagggatggaattagggaaacttcagttggcttttgggcttgcaagtttggtgaatgcatttaaatgggattgtgctgttgatggggaattgcctgatatgagtgaagatcattgctttattctcctcatgaagaatccacttcaagcaagaattactcctcgcacccattaa

SEQ ID NO: 280 - DNA, 1509 bp, Stylophorum diphyllum
atggaaagcctaatcgatttcagcaacccagcaaaaatggaggaactcatgagcaatccatggataattactgctatcacattagcagtagtgattatcatgatgacgattttcagacggaaatcgtcgtctatgaaatggccaaaggggccgaaaacgttacctatcataggtaacatgcatcttttcggtggcaccgatctccatgtcgttttatataacattgccaaagtttatggcaatgttatgactatatggattggtagttggagacctgtgattgtcatctctgacatcgaacgagcttgggaagttcttgttaacaaatcttctgattactcggctcgtgacatgcccgaaatcaccaagcttatttcgtctgactggaaaacaatttcaacttctgatgcgggagccttttggactaatctccgaaaaggacttcaaaatgtggctctatcacctcacaatctagccagtcaatttcaattccaagagagcgacattaagaaactgattgaaactatcaaagaggaaggggcggtcaacaatggaatcgttaaaccacttgatcatctcaagaaggcgatggttaggttaatcagccgattaatctttggtcaagatttcgacaatgataagtatgtcgaaggtatgcaccatgctatcgaagaattgattcgtgttagtggatatgctcgtctggccgaagcattctattatgcaaagtacttaccaagtcacaaaaaagcagtgagagacgtcgaagaagcaaatcggagggttcagaaattggtacgtccatttctttcattaaaccctcctactaacacttacttgcattttcttagatctcaaaactactcagaggaagttatcatatttgcaatctttgaagcttaccttttgggtgtggatagtacttcttcaactactgcatgggcacttgcatttttaatacgtgaaccaaatgttcaagagaaactttaccaagaactcaagaattttacagttaaaaatggccgcgacatgttgaaagtcgaagatataaacaagttaccatatttacaagctacgatcaaagagactatgaggatgaaacccattgcaccattagcaattcctcataaagcttgtagagacacttcattaatggggagcaaaattgataagggcactagggttatggttaatatctatgcattacatcataatgagaagatttggaaggagcccttcaaatttatgccagagagatttttgcaaacagagggggaagtgaatgggaaagcaatggagcaatcatttttgccattcagtgcaggtatgaggatttgtgcaggaatggagttggggaaacttcagtttaattttgctcttgctaatcttgtcaatgcctttaaatggtcttgtgttgctgatggggtacttcctgatatgagtgatcaattagggtttgttcttgtgatgaagacccctctcgaggcacgaatcactcctcgttgctag

SEQ ID NO: 281 - DNA, 1473 bp, Stylophorum diphyllum
atggaggagagtttttggttggtaactgctactgttgtagtagtctttgtaatagcaaaactacagttcaggaaatcatcttctatctctacaatggaatggccagcaggtccaaaaacactacccattattggaaaccttcatcaattaggaggagctgccttgcatgttgttttagcaaatcttgctaaagcttatggaagtgttatgacgatttgggtgggttcttggcgcccgatgatcgtcataagcgacttcgacaaagcttgggaagttcttgttaataaatcatctgattactctgctagaagtttgcctgaaatcactagaatcatctctgcaaattggaagaacattatgacttctgattctggtcctttttggcaaaacctaagaaaaggtcttcaaagtggtgccttatctcctcataatgtcatgtctcagtatcaattacaagagagagatatgcaaaatttgatcaagaccatgcgcgtcgaagcttttaaaaacaatgggagaataaaacctcttgatcatttgaagcaagagacggttcgattattgagtcgacttatcttcggccaagattttaatgatgagaaattggttgttggcatgcaccatgcgctcgacgatttagtacgtataagtgggtacgctagtcttgctgatgctttcaaattcgctgaaaatttacctagtcacaagaaatcaattcgcgaagttcacgaattgaagaaacgcgtcgaaaacctggtacgcccacatatcgtttctaaccctcctactaacacttatctaaattttcttcagtctcaaaattttagtgaagatcttataatctctgcaattttagaagtttatgatttgggtgttgatagtactgcatcaacaactgtttgggcacttacatttttggtaagagaactaaaagttcaagaaaagctttatcaagaaatcaagaacttaactggtggaagatcaacagttaaggttgaagaagtgagtaagatgccctatttacaagctgtgatgaaagaaacaatgaggatgaaacccattgctccaatggctatccctcatacagctgcaagagagacttcattaatggggaagaaaattgataagggtacagtggtgatggtgaatctttatgctattcatcataaccctaatattttccctgagccctataagttcatgccagagagattcttgcatggtgaagagcaaaatggtggtaatattaaagaaatggagcaatcacttttgccatttagtgctggaatgagaatttgtgcagggatggaattagggaaacttcaattgggttttgcacttgcaagtttagtgaatgcatttaaatgggaatgtgctgttgatgggaaattgcctgatatgagtgaagatcattgttttattctcttgatgaagaatccacttgaagcaaaaattactcctcgcacccattaa

SEQ ID NO: 282 - DNA, 1467 bp, Thalictrum flavum
atggaggtgaatctatggcttgtttctgctactttcgcaacattactagccataacaaccttaatccgaatgtttaaatcttcttcacaaatgaaatggccaagtggtccgaaaacactgccaatcatcggtaacatgcatcaactaggtggggatctacttcatgttgtcttggcaaaacttgcgaaagttcacggcggtgttatgacaatatggattggttcttggcggccgataattgtcgttactgacattgataaagtatgggaggttcttgtaagtaagtctgcagattatgcagcacgagattttcctgaattcactaattttgtaactgcaagtcgccacaccatttctagctctgatcttggtgctttctggcaaactcttcgtaagggacttcaaaatggagccctgggtcctattaatatcgctgcacaaagtcaatttcaagaaagagatatgaaacaaatgactcaagctatggtggatgaagcaggaaggaacaataacattgtcaaaccaatggaacacattaagaagaacagtgtaaggttactaactcgccttattttcggagaaacttttgatgatgacgagtttgttgattcaatgctttatgatgtcgatgatgttattcgtattggtggctttgctcgtctcgctgaggccttctattatgccaaatatctaccaggtcacaggaaagctgtgagagaagcaaatctcttgaagcttagagttgaaaagttgatcaggccgttcttctcctcaaatcctcctaaaaatagctacttgtatttccttctctcacaaaatatcccagaagaagttatcattttttgcatatttgaattgtactgtctaggggttgacagtacttcctccaccacaacatgggcactagcatacttggtccatgagcaagcagtccaggaaaagctttaccaagagattagaatgaccctcggtgatgttgatcaagttaggattgaagatgttagcaagatgaagtatttgcaagctgttgttaaagaaactatgagaatgaagccaatagcaccttttgctatccctcacatgactgcaaaagatactacactgatgggtactaaggtagcaaagggcacgtcaattatggtgaatctttatgccctacatcataacccggacatatggactgaaccgtacaagtttataccagaaaggttcatgcaaggagaagatggaagtgctactaacaaagctatggaaaggtcattccttcctttcggtgcaggaatgcgaacatgtgcaggaatggatttgggtaagcttcagtttgcttttgttcttgctaatctggtgaatgcgttcaaatggtcttgtgtggaggaaggtaagctcccagacttgagtgaagacctagcctttgttctcctaatgaaaactccactcgaagcaaagatcacccctagaaaatcttag

SEQ ID NO: 283 - DNA, 1479 bp, Xanthoriza simplicissima
atggaaatgagtccgacattgcttgtatgcgctaccgtggccattgtgtttaccataacaaccataatccgaaatctattctcgtcctcatctttttcacaaatgaaatggccaactggtccaaagaaattaccagtcatagggaacttgcaccagctaggcgatgacgtgctccatgtcgctttggcaaaacttgctaaagtccatggtagtgtgatgacaatctggattggtagctggcgacccgtcattgtaattagcgacatcgacaaagcatgggaggttcttgtaaacaaatctgcagattatggagcgcgtgacatgcctgaaattactaaaattgcatcagctagttggcacaccatatctacctctgatgctggtcctttctggcagaatgttcgtaagggacttcaaagtggagcaatgggtcctctcaatgtcgccgcacaaaatcagttccaagaaagggacatgaaacgcttggtcaatgctatgagcgacgaagcactgaacagcaagggtattgtgaaaccacttgaccacattaaaaagaacactgtgaggttactaactcgtcttattttcggtcaaacctttgatgatgacaagtttattgaatccatgcattacgagattgaagatattattcgcattagtggctatgctcgtcttgccgaggctttctattatgccaagtatcttcccagccacaaaaaagccgagagagaagcatttctagtcaagtgtagagttgaaaagttggtaaggccacttctctcttcaaaccctccatcaaatagctacttgtactttcttctctcacagaattttgaagaggaagttataatattttgcatttttgagctgtaccttctcggcgtggacagtacttcctctaccactacatgggcactcgcctacttgatccgtgaacaaggagcacaagagaagctctaccaagatattaggatgacacttggtgatgtggatcttgtgaagattgaagatgtgagtaaattgaagtatctgcagggtgttattaaagaaacaatgagaatgaagccaattgcacctcttgctattccacacaagactgctaaggaaactacgttggtggggactaaggtggcaaagggtacgcgaattatggtgaacctttatgccttgcatcataacgaaaacatatggcctgaaccttacaagttcatgcctgagaggttcttggaaggtgaagctaaaactgcttataacaaagcaatggaacaatcgtttcttcccttcagtgctggaatgagaatttgtgcaggaatggacttgggaaagcttcagtttgcttttgccctcgctaacttggtgaatgcattcaaatggtcttgtgttgaggaaggcaagtttcctgatatgggcgaggaactatctttcgttctcctgatgaaaacgccacttgaggcaaggatcgctcctagaaatgtttga

SEQ ID NO: 284 - DNA, 1065 bp, Berberis thunbergii
atggaaacaggattagtagcacctatcccattatcagtacaaaatgtacaagatctttctactaagaaccttgatgtgatcccctcaaggtatatccggcctgaacttgcgaatgatattatttcaattgacgaaggatccaagatcccgatcattgatcttagcaaacttactgatgagcaattctgccaagatgaattggagaagtttcatttagcctgcaaagactggggcttctttcagctgattaatcatggagtacaacaagatgcattagaaaatgtgaaaagagaggttactgaattctttaagctgccatttgaggtaaagaaggaattctctcaacagccaggggaagttgaagggtatgggcaggcctatgtgttctccgatgagcaaaagctagactggggagacatgctttaccttattacccaacccgacgttgcaagaaacatgaagctttggcctacttcccctcctacgttcagggaaacaattgtcaagtactcagaagagttgcaaaaagttaagatgtgtgtcatggcttctatggcaaagaacttggagattgaaacagagaagtttacaaatatgtttgagaaagggatacagagtatgaggtttaattattatccaccgtgcgtcgaggatgataaggtgttgggcatctctccacactctgatgccactggtattacattcctaattcaagtcaatcatgttcatggactacaactcaggcacaaggggaattgggttcccgtcgtgctcacaactgatgctattcttgttaacattggggatgttctcgagattttaagcaatgggaagtacaagagcatcgagcacagagttgttataaacaaaaccaaggaacgcctttctgtcgctgcattccatgaagtaaatgataatgtgatgattggacctcttccagaactcatcaaacagggcgaagataagtattacaagagcttaagtttcgccgactacacaaagctcttgaacagtgagaaacttgatgggaagactctcattgaacaaatgaagttgaagaactga

SEQ ID NO: 285 - DNA, 1071 bp, Berberis thunbergii
atggaagtagatgagataaggtcgtatggtgcgtctctcccagtagagaatgtgcaggctcttgctgctaaggacttgaaggagatccctgaacgctacatcaggcctgaactagaatttgatgtcgttgtttccattgagaattctggagaaatcccggttatcgatctatcaagactccttgacgaacattttgcacatgatgagctagctaagttacactctgcttgtgaagaatggggcttctttcagttgatcaatcatggagcatcagaggaagtgattgagaaaatgaaaactgacacacaagagttctttaggctgccactggaagagaagaaagcttacacacaagtatccaatggcattgaaggctatggccaagcctttgtgttttctgaggagcagaaacttgattggggtgacatgcttttccttttcgctttacccatcaaccaaagaaacttcaagttttggcctaccaaccctacttctttcagggaaacaacggaaaagtattcactagaggtgcacaaagttgcaatatgtcttttaggtttgattgctaagaacctggggattgaaccagaaaagttcacaaaagtatttgaggatggtatgcaacattttaggttgaattactatgcaccatgtccacacgcacacaaggttttaggcctttctccccactctgatggttctgcccttactctgcttactcaagtcaatgatgatgttgatgggctgcagattaagaaaaatgggaattggatgcctgttaaacccatttcaggtgcttttatcgtcaatattggtgatgtcattgagataacgagcaatggaaaatacaagagcatcgagcacagggccattattgacccaaagaaggaacgcctctcaattgctgcatttcacaaccaaaacttcagaacaacaattggccctttcccagaacttgtaaagggaaatagtacagagaagtataagaccgtaagctaccaagattacttaaggaatattacttctactggccttgatggtaagaacagattggaattcatgaaattatga

SEQ ID NO: 286 - DNA, 1128 bp, Corydalis chelanthifolia
atggaggaggtgaaagaggagttgtcaccgaaagcattagtgaactctggaagttctttgcttgtaccttcagttaaagagcttgccaaagaacaacttactgaaatcccaagtcgatacatacgttttgatcaggaatctcctgtcactaccttccaaccaacttgtctcccaagtgttcctgtcattgatattcacagcttgctttttcaagaatccgaagcggcaactgcatccgaattgaatagattacattcagcttgcaaaaactggggtttctttcagataataaaccatggagttagttcctcgttgattgagaagataaaattggagattaaagctttttttgaacttccaatggaggaaaaacagaagctatggcaacaaccatgtgatcaggagggatttggacagctctttgttgtttcggaagagcaaaaacttgattggtgtgacatgttttttatcagaactcttccaactacaatacggaaacctcacttatttgaaaagctccctgtgcctcttagagaaacattggaaaattactctttagaaatgaaaaaactcgcgaagactgtcttagaacaaatggctaaagctctaaagatggatgctgaagagatgagactgttgttcgatgatggttttcaagaaatgagattaaattactatcctttatgttctcaacctgagaagactataggctttaccccacattcggatgccagtgctcttacgattctccttcaactcaatgaaacagaaggtcttcagatacgaaacgaagggaaatgggttcctgttaaacccctcccaaatgcctttgtagtcaacattggagatgttatggagattgtgagcaatggtatttatcatagtattgaacacagagcagtagtgaactcaacgatggagaggctttccattgccacattttataggactaatcttgaagcagaaataggccctgcacgtagtttgatcggacctcataagccagcagtgtttaagcgggttatgacagagaagtactacaaggatttctttgctcgagaaattaaaggcaagtcttaccttgattccatgaggattaatggaactggagaagagaaaagtagttga

SEQ ID NO: 287 - DNA, 1113 bp, Corydalis chelanthifolia
  misc_feature (1063)..(1101): n is a, c, g, or t
atggctcctgcaccaatttcttccattaatgttggacatattgatgatgttcaagaactaagaaagattcaacccacaaaaatccccgaacgatatgtgcgtgatatcgctgagagacccacaaaaacccatgcaagatcacccatgcaaatacccgttattgatctttcgaaactgatgcgaaatgacaaagaaatggctcagaatgagttatcaaaacttgcctattcctgcgaaaactggggattctttcaggtaatcaatcatggtatcgatacggagttaatcgagtgtatagaggaagtagccaagaagtttttcatgttaccattggaagagaaacagaaatttccaatggcgccaggaacgcttcagggctacgggcatgctttcgttttttcggaggatcaaaaactagattggtgtaacatgttagctcttggggttgaaccctttttcataaggaacccaaaactttggcctacaaatccagctgagttcagtgaaacacttgacctatactctgcaaacataaggaaactatgtaaaattctattaacattcatagctatgagccttggattaaacgatgatatgttcaacgacatgttcgggactgcagttcaagctgtaaggatgaattactacccgccgtgttcaagacctgatctagttttgggtttaagtccacattcagatggcagtgctctgacagtattacaacaagctaaaggtagttcagtaggacttcaaatccgaaaagacgataaatgggtacctgttaaacctgttccaaatgcacttgttatcaatatcggcgacactatagaagttctcactaatgggaaatacaaaagcgtcgaacatagagcagttacaaacaaggagaaagaccgtcttacaattgtaacattctatgctccaagctatgacatcgagctcggcccgttgcctgaatgtatcgacgaaaacagaccatgtatgtacaaaaaatacaatcatggagagtacagtaaacattacataaccagcaagttagagggcaaaaagactctagacttcnnnnnnnnnnnnnnnnnnnnnnnnnnnnnnnnnnnnnnnaccaaaatttag

SEQ ID NO: 288 - DNA, 1140 bp, Corydalis chelanthifolia
  misc_feature (174)..(176): n is a, c, g, or t
atggaggaaatacacctggtttccactgtagctgatgatcatatatcatcaattgtgaatcagagggtgcaagactttgccatcaacgtcaaagaaccgccatcgaggtatatccgtaaagctatcaatgatgatattgattttggattgaatcaaactaccaccgtcgactannntaaggatgattctttgtcatcttcttcggttcccatcatcgatttgcagcgtttatcatcgtcatccatcgaagagaaaaaagcggagatggaaaagttaagatcagctcttgcttcatggggcttgtttcaggcagttgggcatggtatcccaaatactttgctcgatgaggtgcgtaacatctctaagcaattcttcgaacttccatcggaagagaagcaaaaatactccaaacttggtggtgtcgacacgttcgatgacttggaaggatacgggaacgatccagttacctcgggtgatcaagttctgaactggaatgacaggctctacctcttggtgaaacctgaagaacaaaggaagctcaacttctggcctgagcatccaaaccatttcagggatactttacatgaatatagtgttaagtcaagcatagcagcagagttcattctaaagacaatgtcagagttgttgggtttgaaagaaaagtacctgctaaaccagctgggggaacaagctcctgtatatgtaaggtttaactactaccctccttgtccaaggcctgatcttgtttacggcatgacaccgcattcggatgttggagggatcaccattatcttgcaagacgaagtagaaggtcttcaagtactgaaagacgaaaaatggatcaatgtgcccaccatacctcatgctctactcgtaaacatggctgatctaatggagatgatgagcaatggacagttcaagagcccagtgcatagagtgataacaaatgcagaaaaggagaggatatctttagctatgttcttctcaccagaattagataaagaaatccaacctgcagcagaattaatcgatgatgataaaccgaggttgttcaagaaggtgatcgtgaaagaatatttcaaatatttctttccaaggtacttggaagggaagcgagcaatcgattgggccaaagtttga

SEQ ID NO: 289 - DNA, 1056 bp, Corydalis chelanthifolia
atggaagtgaaaaccctagcagagagccgattacctcatgttccacctcaatacatacaaccagttgagaatcgtccggcgatagattcatgccgagaaaaatcatcagatttcggcatccctgtaatcgacttattcaacttcgatccccaatgttccagtggcgcatgccaggaactcggtcgcgcttgcagggattggggtgcgtttcagatcatcaatcatggcgttcccaagagattactcgatgaaatgatgaccgcaggtttgtctttcttcaacgagtgttcttctgcagagaaacggaagtactcttgtgatcctaattcggctgcttcagaagggtacgggagtcgaatgttggttaaagaagatactgttttggattggagggattacttcgatcatcataccttgcccttatctcgacggaatcctaatcgatggccacaatctccgtctagttacagaggagttgtcgtggagtacagtgatcatatcaaatcacttgctgtcaagctaatgagcatgatctctgaaagtctaggtctaccaggttcatgcattgaagacatagttggggagatctaccagaatataacaataagttatataacaataagttattacccaccttgtccgcagccagagctaactcttggtttgcaggctcactctgacataggtgctattactcttttaattcaagatgatgttggcggacttgaggtattgaagggtgaggaatgggtgactgtacaaccgttatctggagcaattgttgtcattttggctgaccaaaccgagataataactaacggaaaatacagaagttctgtccatcgagctgtcaccaattctcatcgggctcggctatcagtgggcacatttcacgacccaagtaaatcaaggaaaatatgcccagctactggacttattagcaaagactctccagcaaaatatcgggaggtggtttatggagactatatttcagcttggtatagcaagggccctgaaggcaaacgtaatatcgatgcccttctaattcatgagtag

SEQ ID NO: 290 - DNA, 1089 bp, Corydalis chelanthifolia
atgaagaatgagatgatcattgaaaagggacttggtggctctctccctgttgagagtgttcaagctctggcttctaaagatttgaaggacatcccggcacggtatatccggcctgaattggagtctgatgttgttaacactgatgggtctctcgaaattcctgtgattgatctgagcagactccttgaccaacaattcatgtatgaagaactgaaaaagtttcactcagcctgcgaagactggggcttctttcagttgatcaatcatggagttccagaggaagttgttgacaaaatgaaggttgatgtagaggagttctttaagctacccttagaagagaagaaaccttactcacagttaccgggcgttttagaaggctatggtcaagcctttgtggtgtctgaagagcagaagcttgattggggggacatgcttttcctccatgcccaacctgttgttggaagaaacatgacactttggcctaaacacccaacttctttcagggcaacacttgataaatactcatcagagttgcaaagagtgactgtctgtttgatagaatgtatggctaagaacttgggttttgttgatccagagaaattgacaagcatgtttgagattggttgggaaggagtaaggatgaactactatccaccatgtgtagtaaatgcagataaggttttgggtatttctccacattcagatgcaactggactaactctactcatccaagtcaatgaagtgcaaggattacagatcagaaagaatggaaactgggtacctgttaaaccaattccaggggcattcatcgttaacatcggtgacatgattgagataatgagcaatggaaagtacaagagcatcgaacacagggcagtgatagatccgttgaaggaacgaatgtcgattgctgcatttcacagtccagagcctaaaacaataggtcctctcccagagatggtaaagatgagtggtggtgtggagaaatacaagactttaaactatgttgaatacttgaagctcttgtactcttcaaaacttgatgggaaaaatctattggaattcatgaaattggatcagggtatgtaa

SEQ ID NO: 291 - DNA, 1119 bp, Corydalis chelanthifolia
atggaggaggagaaagaggagttgtcaccgaaagcattagtgaactttggaagttctttgcttgtaccttcagttaaagagctagccaaaaaacaacttactgaaatcccaagtcgatacatacgttttgatcaggaatctcctgtcactaccttccaaccaacttgtctcccaagtgttcctgtcattgatattcacagcttgctttttcaagaatccgaagcggcaactgcatccgaattgaatagattacattcagcttgcaaaaactggggtttctttcagataataaaccatggagttagttcctcgttgattgagaagataaaattggagattaaagctttttttgaacttccaatggaggaaaaacagaagctatggcaacaaccatgtgatcaggagggatttggacagctctttgttgtttcggaagagcaaaaacttgattggtgtgacatgttttttatcagaactcttccaactacaatacggaaacctcacttatttgaaaagctccctgtgcctcttagagaaacattggaaaattactctttagaaatgcaaaaactcgcgaagactgtcttagaacaaatggctaaagctctaaagatggatgctgaagagatgagacagttgttcgatgatggttttcaagcaatgagattgaattactatcctctatgttctcaacctgacaaggttctaggcttcaccccacattcggactcttgtgcacttacgattctccttcaactaaatgaaacagaaggccttcagatacgaaacgaagggaaatggattcctgttaaacccctgccaaatgccttcgtagtcaacattggagatattatggagattgtgagcaatggtgtttatcgtagtatccagcacagagcagtagtgaactcaatgaaagagagactttctttcgtgacattttatagcaccaatatcgatgcagaaataggccctgcatgtagcttgatcgaacctcataagccagcattgtttaaacgggttatgacagagaagtactataaggatttctttgctcgagaaatcaaaggaaagtcttatcttgattccatgaggattaatgtaagtggagaaagttaa

SEQ ID NO: 292 - DNA, 1044 bp, Corydalis chelanthifolia
atgggattcgtgaagaatttatcagaatcaactatcctgacttcaattccctccgattatgatttctccaccatcaactccgactactccccctccgtcaccacagaagaagaatcaattcccatcattgatttctccctcctcacttcttcttctccacagcagaggtctcaaatcgttcaagaccttggcaacgcatgtcttcaatggggtttcttcatggtggtcaatcatggaatacctgagagattgaaggaggaggtgtttcaatcatgtcaagatttctttgatttgagtgaggatgaaaagcttggttacactgcgggaaagcatgtgttggatcctatcagatgtggtactagctttaatgcttcagttgagaaggtgttcttttggagggattttctcaaggtctttgttcatccagagtttcattcccccaagaaacccattggtttcagtgggatttccaatgagtattccaaaagagttagagaaatagcaagggaattgcttaaagggatatcagaaagcttgggattagaagcatcatatatagagaaggcaatggagctgcaatctggcttacagatattcgttgcgaatctataccctccctgcccacagccggaactcgcgatgggcatgccgccacattctgatcatggcttgctgactctcctaatgcaaaacgatgttggtgggctgcaggtgaaacacaagggaaaatgggtccatgtgaatccactgcccaattctatactgatcaatactggagatcatcttgagatattgagcaacgggaaatacaagagtgttctacatcgagcaacggtgaacaacaatactacaaggatatccatagccgtggcgcatgggccatctttggacacattggtaacaccggcaccagggttggtcattagtgaaattcatccacctagatatcatgggatgaaatataaagagtatttagagcttcagcagagcaaccaactagatggaaaatcctgcctggatcgggttcgtgtgttgaatgtctaa

SEQ ID NO: 293 - DNA, 1086 bp, Cissampelos mucronata
atgacgacgtgggtaccttctctccctgtgccaaatgtacaagatcttgcagcaaagaaattggaggaggtccccgacaggtacattcagcgagaagcggagtcggaaaatgtcgcaattgagttgtccgatcaagttccagtcattgatcttcaaaggctcctacaccacgacccctccatcgcttcggacgaaatggccaagtttcacatggcctgtaaggactggggcttcttccagctaatcaaccatggtatggatgaagaactgatgaggaagatggtgaacaatctagaggagttcttcaatttgcctttagaggagaagaaagcatatgcccagacacccgaaagcttcgaaggttacggacaggcttttgtggcgtccaaagagcagaagcttgattggtcagacatgcttggccttcaaaccctccctgttaatcgaagagccatgcgggtttggcctaagaaacccctttcttttagtgaaacgattgacaagtatgcatttgggatgcaaaaagtcacattctgtttgctgagcttgatagcaaagaatttgggagttgaaccgcagaagctgacgagcatttttgaggatggaatacaggggactagaatgaattattactcgccatgcccacaatcggacaaggttttgggtctctctccacactccgacgcaaatttaatcactctcctcattcaaaacaatgatctcccggggcttcaaataaaaatagatggtaaatggatccccatcaagcctatctctggtgccttcattgttaacatcggggactccattgagatactgagcaatggcttgtacaagagtattgaacacagggcagttatacacgctgatcgagcacgcatatcgatagcggggtttcaggctccaaggagtggagtcgttattgagccattaccagagctcttagagaaggaaaatgttgttgcaaattacaagagtgtggactatgaagagtatttgaggcaatacttctctgctaaacttaatggaaagagcatgttggatcttataaagttaaagatacacaaggacgaagagagggcttga

SEQ ID NO: 294 - DNA, 1050 bp, Cissampelos mucronata
atggagagcttatcaattgatgctagtagtgttctagatctggtgtcgaagaaccctgaaaccatcccttcaagatacattcgaccggagaatgatcaccaaatcgtggtgacttccattcataatgaggtcccagtgattgacttgagcaagctcatctttgatgctaataatggcggggtttctgacgaagagatgaaaaatttgcatcttgcttgtcaagaatggggcttcttccagttggtgaaccatggagtggatgaggaggctatgaagaaaatagttgaagatgtgagggagttcttcgagttgccacttaagctaaagaaagagtgctcatcagagatggaaggatatggtcaagcctttgtgttgtccgaagaacaaaagcttgattggggagacatgttttttcttttcacgggaccagatagtattaagaactatgaggtctggcctgctcatcgtcccttcactttcagggaaactatcaacaagtattcatcagagatggaaaaaatcaaaatcatattggttggtctaatggcgaaaaacttggggattgatcaagacaagttcataaacttgttcaaagatggagttcaatcaatgaggatgaactactacccaccatgccctgatccatccaaggtgttgggaatttctccccattccgacgccactggcattacaattctacttcaactcaatgaagtcgacggacttcaaatccgtcatggaggaaattgggttcctgttaaaatgcttcctggtgctttgctagtcaacataggcgacattattgagatactgagcaatgggatatacaacagcatagagcacagagtggttataaataaggagaaggaacgtatgtcagtggccacgtttcatgaaacgcataatagtgtggatattgggccgcttccggagctagttatcaatggagaaactaagtacaagagtgtggcttgggatgaattttcggagttatttctctctcagaagcttgacggaaagagtctcttggatgccttaaagttgaattaa

SEQ ID NO: 295 - DNA, 1167 bp, Cissampelos mucronata
atgttaagagaaaaaatgaccatagaagcaaaagaaaagcttatctcaattcattcaatctctgaagaagatcagctgatctccatggatcatcaggttccattgactcttgggagctctcttctggtgcctagcgttcaggagatggcccgaaaatcagctcttgacgccatcccgaaacgctacatccgcgacgatttaaggcaggagttgatgaatgtaaccagatcagatgagactgatcgtttgcttccaagtcttcccgtcattgatatgaaggctttgcttgatgagagggacgtggagttggagaagttgcactccgcttgtaaggactggggtttctttcagttagtgaaccacaatgttgatgagaatttggtggagaaggtcaaaggtgtgatacaagatctcttcaatcatccaatagaggaaaagcagaaatactggcaaaaaccaggagacctggaaggatttggacaggcctttgttgtttctgacgagcaaaaacttgactgggcagatatgttttatatggtcacccagccagaacattcaaggaagccccacttattcccattgctccctcaccctatcagggaaactttcgaagaatactcaattgagttgaagaacctggccttgaaggtcttgaaaatgatggcgaaagctctgaaaatggacgtggaggagatgaattcgcttttcgcagaggggaagcaagcatttaggataaactactacccaccatgtcctcaaccggagaaggtcattggcctcacacctcactcagatgctgttggtttaacaattctcctacaagtaaacgacgttgagggtctccagataagaaaggatggaatgtgggttcctgtcaagcccctaccaaatggattcattgtaaatgttggagacattctggagatggtgacgaacgggaactaccgcagcattgagcatagggctgtagtgaactcatcgaaggagaggctctcaatcgcaacattttacagtccaggagtggatgcagaaataggtccagcacctagcctcatcaactcgaattcaccgccgatctttaagagaataaacggagaagactacttcaagggattattcgctcgagagctagcagggaaatcttacctagactgcatgcgaatctga

SEQ ID NO: 296 - DNA, 1068 bp, Cissampelos mucronata
atggccactgaacaagaagaatactttccaagtctcccagtccctaatgtccaggacctttcatctaaccttgcgaatgacatccccgacagatacatccgaccggagttccaatcggaatttgtctgcgacgacaagtccttcgcaattccagtcatcgacttctctaggattcttgatgaaaagtttcgcgaccatgaaatgactaagcttcatgctgcctgccaagaatgggggtttttccagttgataaatcatggatcagaagaagcaattgaggagatcaagagtcacgtcgaggagttctttaaacagccattagcggcgaagaaggcttacacgcaagagcgcaacagtatagagggctacggccaagctttcgtgcagtccgaagatcagaaactcgactggggagacatgttcttggttcgcgccttccctgttcgcaaaagaaacatgagattctggcccaactatccaagcactttcaggggaacacttgataggtactcatccgaggtgcgaaaactcgcgatcggattgctgggtttgatggctgagaacttgggacttgacgcagagaagctgactggcatgtttggagatttgcagcaatcattgaggatgaactactatccaccatgcccgcaagctgataaggttgtcggcatttcgccgcactctgatcctttacctttgacattgctaattgaggccaacaatgtgcaaggactgcaaatcaggaagaacagtatctgggtgcctgttcatgccatccctggagctttcatcatcaacataggtgacatgttagagatatggagcaatgggaaatacaagagcattgagcatagggttgtggtgaacccctatagggaacgtctctcggtggctgcatttcatgctccaaatgaagactccatcgtaggtcctctccaggatcttgtaaacaaggaaggtgcaaagtacaagtctatagacgcaaacagttactacaagctcaaaaatacaatccaagggaaaatgcatgccaatgaaatgaaactagtgactcctacgacgaattaa

SEQ ID NO: 297 - DNA, 1122 bp, Chelidonium majus
atgagttgttcttgcccacaagtggattggcctgaaccaattgtccgagttcaatcaatatctgacagtggttcacctgttattcctgatagatatatcaagccacccttagaaaggccttcaaaattaggtttggctagaaccagtattactagtactaatgatcaagatgtactgaatatcccacttattgatcttggaggccttctaatccaggatgaggataaccttattctccctgattcgattttgaaccaaatttgcatggcatgtcaaaactggggtttcttccaaattgttaatcatggagtaagcccggatttgttgcatcgagtacgcgaagtatggcgagaattcttccatttaccatatgagcataagcaggtttatgctaattcaccgaaaacttatgagggttatggtagccgattgggagtcgaaaagggtgctattcttgactggagtgactatttttacttacactatcttcctcaatgtctcaaggatcctaacaaatggcctgctctccctacttcatgcagggaagtagtcgacgagtactgctgtcaattggtgaagttaagtaagaacttgttgaagattttatcgataacactcggactaggagaatcatatcttgaaaatgcatttggaggagaggaaattggtgcctgtatgagggtaaatttttatccaaaatgtccacaacctgatctcacacttggtctctcctcacattctgatcctggtggcatgacccttctccttcctgacaatcaagtcgtaggtcttcaagtacgtaaagacgataattgggttacagtaaaacctgctccgaatgcgtttatcgttaatataggtgatcaagttcaggttctaagcaatgcgatttacaagagcgtggaacaccgggttgttgttaattcagttgaagaacgcgtttctctagctttcttctttaacccaagaggtgatttgcccctgcaaccagcaaaggagctcgtaacatcggaccgtcctgcgctttacctgcccatgacgttcaatgaatacaggctttacattaggacacagggtccccgagggaaagtatatatggaatcactaaaatccccacgttaa

SEQ ID NO: 298 - DNA, 1089 bp, Chelidonium majus
atggagacaccaaagccagtaactctaggtggttcgttgcctgtaccaagcgttcaggagttggccaaacagccccttttacaagttccacctcgatatatacgctcagatcaagaccttccaatcatctctgaatctgacgatgtatctgctacatttcagactgttcctgtcatagatttgaaaagtttactatgtggagatactgaattggaaaggcttcactcagcttgcagagaatggggtttctttcagttagtaaatcatggagttaatacttcattggtagagaaagtaaaatcagagattcaggatttcttcaaacttccaatggaagaaaagaagaagtattggcagaaggaaggagatgttgaaggatttggacaagattttgttatttccgaagagcagaaacttgactgggcagatatatttttcatgatcactcttccccgccatgcaaggaaatcccacttatttccggagctcccgttgcctctcagggaaactttggaatcctactcctctgagatgaaaaatctagccatgagtctcttcgaggtgatgagtaaagctctagatgttgaaactcagcttgtgacagagttgtttgaagatgggatgcaaaacatgaggatgaattattatcctccttgtcctcaacctgagcttgttgttgggctcacaccgcactcggatgccgtgggtctaaccatccttcttcaactcaatgaaatggaaggattacaaataaaaagggaagagaaatgggttccaatcaaacctttaccaaatgctttcatagtgaacattggagacatcttggagatcgtgactaatggaatctataatagcgttgagcatcgagcaatagtaaactcgaagaaggagaggctttcaattgccacattccacagcatcaaactaggtggagaaattggtcctataccatgcctggttactccaaagacccctgcattgttcagaacagttggagttgcagaatattacaagcataggtattctcgaacgctccatggaaagtcataccttgatttcatgagaatagagggcaaccatgacagctga

SEQ ID NO: 299 - DNA, 1119 bp, Chelidonium majus
atgacaatggaaccaacaattttggagacaaaaacagaagagaagtcaatatcagagagtactacataccaaaaaggagtgaaacatctttgtgagtgtggggtttccaaagttccaaacaagtacatctttccagtttctgagagaaagggagaagaacccaagaactctggttccaacctcaagttgcctgtcattgattttgatcaattgaaaggttctaacaggtgtcaagttcttaattctctctcaaaagcttgtgaagattttgggttctttcaggttataaaccatggcattcctgatgatattattcaaaatatgatcgaaaccagtcgagggtttttcgaactccctctcgaagagagatcaaagtacatgtcgaccgatgttcgtgcaccggttcgatatggaactagttttaaccaaatcaatgatagtgtatactgttggagggacttcttgaagcttgcatgccattccttaccagattctgttccccattggccttcttctcctgcagacctcagggatgcagcatcaacttacgctgaagaaaacaaatccttgtttaaaatgatcatggaagccatcttggagagcctaggattgattcgaacaaccgaaaccgatgacgataatgatgttctaaaagaattcgaagacggtagccatctcacagttatcaattgctacccatcttgtccccaaccagagctaactcttggtatgccaccgcattctgattacggattcctcactcttcttcttcaagacgaagtcgaaggccttcaaatacaacataaaggcgaatgggtaaccgtcgaaccgattccgaacgctttcgtcatcaatatcggtgatcatcttgagatatttagcaatggaagatacaagagtgttctacatagagctatagtgaattctacaaagtgcaggacatctattgcttcattacatagtatgccaatgatgaatatggttaagccatcaccaaagctcatcaatgaagagaatccaaggcgttacaaagacacaaactttgctacttttattgacttcattgcatctaatgacctcaaggagaaaagttttcttgattccaggaagttgacttga

SEQ ID NO: 300 - DNA, 1113 bp, Chelidonium majus
atggagacaccacccaaggtaataagtctaggaagttctttgcctgtaccaagcgtccaggaattggtgaaacaaccactggaaagagttccacctagatatgtacagcaacaagatcaagactcatccagattggtcatctcctctgatgactcctgcttggttcttccaacagttccagtcattgatttacagaatttgttatctccagaatccatcattggagacttggaactagagaagctggactccgcttgcaaagaatggggtttctttcaggtggtaaatcatggaatcaccaacacattggtggagaaagtaaaattagaggttcaagacttcttcaaacttccagtggaggaaaaacagaagtatgaacaaataagaggagaaattgaaggatttggacaagcctttgttatatcaaaagatcaaaaacttgattgggcagacttattcttcatggtcactcatccccttcatttgaggaagccccatttatttcccaagctccctctacctcttagggatactttagaatcctatacaacagagttgagaaatctaaccatgactctcttagagtcaatggcgaaagctctacgacttgagaccaaagagatgacagatttgtttgaagatggaaggcaatcaatgaggataaattattatcctccttgtcctcaaccggagctcgtcatcggcattaggcctcactcagatgccactggccttacaatcctccttcaactcaatgaaacagaaggattgcagataagaaaagaagggatatggatccccattaaaccactaccaaatgctttcatagtcaacattggagacatgctagagattgtgacgaatggcgtttatcgtagcgtcgagcatcaagtaacagtgaataagatgaaagagaggctctcaattgctacactctacagccctggcttagaaagagaaataagtcctttacctagccttattaccccacaaacccctacattattcaagaaaattgaagtggagaagtatctcaaagaactatttaatcgagaactcaatggtaaatcattccttgatgtcatgaggacagaagggggagggaaggaataa

SEQ ID NO: 301 - DNA, 1071 bp, Chelidonium majus
atggaattctccttgtctggaggaacttctgtaggtgtccaaaccctagcggagagtggattggatcatgtcccatcccgatacatacaacccccagagaatcgacctgtaacatcattttcctgccggaaaacgtcagattctggcatccccgtcatcgatttattcaactttgaaccgaaacgttccgacgatgtgcttcaggagctccggagagcttgcagagattggggtgcttttcaggttaggaatcatggggttccgaagagattactggaagacatgataaaagtagggttaagtttcttcaaggagtcttcggtggaagagaagtgtaagtattcttgtgatcccaattcggctgcgtcggaagggtacggtagtcgaatgcttgttaaagaagacactgtcttggattggagggactatttcgatcaccatacgtttcccctctctcgtcggaaccctaatcgatggtctgaatctccctcaaattacagaggagttgtggaggagtatagtgatcacataaaggtgcttgctttgaagttaatgagcatgatctctgaaagtctaggtctacaatcgtcgtgcattgaagacattgttggggaggtctaccagaatataaccatcagttattacccgccttgtccacagccagagcttactcttgggttgcaggctcattcggacattggtgctgtaactcttttgatacaagacgatgttgggggtcttcaagtattgaaggacgatgagtgggtgactgtacagccattatctgatgcaattgttgttattttggccgaccaaactgagattatgacgaatggccagtataaaagttcacagcatcgagctataaccaattcccaccgtgcacggctctcagtgggcacatttcacgacccaagtaagacgaggaaaatcgccccagctgctccgcttatacgcaaggactctccagccaaatataaggaggtcatatatggagactatgtttcttcttggtacaccaaaggccctgaaggaaaacgaaatatcgatgcactcctccttcaccagtaa

SEQ ID NO: 302 - DNA, 1119 bp, Chelidonium majus
atggagacaccaccaaagcagcaagtgactctaggtgtttccttaccagtaccaagcgttcaggagttggccaaacagcccctttcacaagtcccacctcgatatgtacgctcagatcaagaccctccgatcatctatgaatctcatcatgatgtatcatcatctactactacagttcaaaatgttcctatcattgatttgaagagtttgctatctcaggggcctattggagattctgaattggagagacttcatttcgcttgcagagaatggggtttctttcagttggtaaatcatgaagttaacacttccttggtagagaaagtgaaaacagagattcaagattttttcaaacttccattagaagaaaagaagaagtattggcagaaggaaggagatgttgaaggatttggacaagcatttgttatctcagaagagcagaaacttgactgggcagatttgtttttcatgatcactcttccccgcgatgcaaggaaatcccacttatttccggagctcccgttgcctctcagggaaacattagaatcctactcatctgagatgaaaaatctagccatgactatcctagaggtaatgagtaaagctctacatatcgaaaccaagctgatgacagacttgtttgaagatgggatgcaaaacatgaggatgaattattatcctccttgtcctcaaccggagcttgttatcgggctcacaccgcactcggattctgttggtctgaccatcctccttcaactcaatgaaatggaaggattacaaataaaaagggaagggaaatgggttccaatcaaacctttaccaaatgctttcatagtgaacattggagacatcttggagatcgtgactaatggaatctataatagcgttgagcatcgagcaatagtaaactcgaagaaggagaggctttcaattgccacattccacagcatcaaactaggtggagaaattggtcctataccatgcctggttactccaaagacccctgcattgttcagaacagttggagttgcagaatattacaagcataggtattcccgaacgctccatggaaagtcataccttgatttcatgagaatagagggcaacaatgacagctga

SEQ ID NO: 303 - DNA, 1095 bp, Chelidonium majus
atggaaggaagtcacttacctgccgaggaaacctcgtcactagaaaagcgtgtccaagaacttgctatcaactgcaaagaaccaccgccaagatatatctgtaaaacagacaatgaggaggaaaatcagagacctgcagatgatcatttatcatattcagtaccgataatagatctcagccgtttctcgtctaggtcgtccattacagagaaagaagaagagatggaaaagctaagatcagctctgaattcatggggattgtttcaggcaataggacatggcatccccaagaacttactcgatgacgtccacaacgtaacgaagcagttcttcgagcttcccattgaagagaagcaaaagtacacaaaagcagacagcgagatagttgacttacaaggatatgggtgtgacagaattgtctcggaggatcaagttctggactggtccgatcggctataccttttagtagatccagaagaacagagaaagctcaaactttggcctgaacctccaagtaatttcaggaacacattgcacgaatacagtgccaagtcgagttcagtggctgagctcattctaaaggtcatggcggaatcagtgggtttggaggagaataacttcctcagccagataggtgaacaagtgctgacatatgcgaggtttaactactaccctccttgttcaagacccgatcgtgtttatggcatcaaggctcatgcagatggaggagcgctcaccattctattgcaagacaaggaagtagaaggtcttcaagttctcaaggatgatcggtggatcaatgttccgagcatcccgtatgctctgcttgtaaacgttgcggatctaatggagataatgagcaatggactgttcaagagtccagtacacagggtggtaacaaacacagaaagggaacggatttccttggctatgttctactcaccagcatttgataaagaagttgaaccagcagcagggttgattgacgagagtaaaccgaggatgttcaggaaagtgaatgtgaaaaactatcttgaagtcttcttcccgagatacttgcaagggaaacgagcaatagattgggccaaagtttaa

SEQ ID NO: 304 - DNA, 1089 bp, Chelidonium majus
atggagacaccaaagccagtaactctaggtggttcgttgcctgtaccaagcgttcaggagttggccaaacagccccttttacaagttccacctcgatatatacgctcagatcaagaccttccaatcatctctgaatctgacgatgtatctgctacatttcagactgttcctgtcatagatttgaaaagtttactatgtggagatactgaattggaaaggcttcactcagcttgcagagaatggggtttctttcagttagtaaatcatgaagttaacacttcattggtagagaaagtaaaaacagagattcaagatttcttcaaacttccaatagaagaaaagaagaagtattggcagaaggaaggagatgttgaaggatttggacaagattttgttatttccgaagagcagaaacttgactgggcagatatatttttcatgatcactcttccccgccatgcaaggaaatcccacttatttccggagctcccgttgcctctcagggaaactttggaatcctactcctctgagatgaaaaatctagccatgagtctcttcaaggtaatgagtagagctctagatgttgaaactaagcttgtgacagagttgtttgaagatgggatgcaaaacatgaggatgaattattatcctccttgtcctcaacctgagcttgttgttgggctcacaccgcactcggatgccgtgggtctaaccatccttcttcaactcaatgaaatggaaggattacaaataaaaagggaagagaaatgggttccaatcaaacctttaccaaatgctttcatagtgaacattggagacatcttggagatagtgactaatggaatctataatagcgttgagcatcgagcaatagtaaactcaaagaaggagaggctttcaattgccgcattccatagcatcaaactagatggagaaattggtcctataccatgcctggttactccaaagacccctgcattgttcagaacagttggagttgcagaatattacaagcataggtattcccgaacgctccatggaaagtcataccttgatttcatgagaatagagggcaacaatgacagctga

SEQ ID NO: 305 - DNA, 1095 bp, Chelidonium majus
atggagacaccaaagccagtaactctaggtgtttccttaccagtaccaagcgttcaggagttggccaaacagcccctttcacaagtcccacctcgatatgtacgctcagatcaagaccctccgatcatctatgaatctcatcatgatgtatcatcatctactactacagttcaaaatgttcctatcattgatttgaagagtttgctatctcaggggcctattggagattctgaattggagagacttcatttcgcttgcagagaatggggtttctttcagttggtaaatcatgaagttaacacttccttggtagagaaagtgaaaacagagattcaagattttttcaaacttccattagaagaaaagaagaagtattggcagaaggaaggagatgttgaaggatttggacaagcatttgttatctcagaagagcagaaacttgactgggcagatttgtttttcatgatcactcttccccgcgatgcaaggaaatcccacttatttccggagctcccgttgtctctcagggacacattagaatcctactcatctgaggtgaaaaatctagctatgactatcctagaggtaatgagtagagctctacatatcgagaccaagttgatgacagacttgtttgaagatgggatgcaaaccatgcggatgaattattatcctccttgtcctcaaccggagcttgttatcgggctcacaccgcactcggattctgttggtctgaccatcctccttcaactcaatgaaatggaaggattacaaataaaaaaagaaggaaaatggcttccagtcaaacctttatcaaacgctttcatagtgaacattggagacattttggagatcttaactaatggaatctacaatagcgttgagcatcgagcagttgtgaactcaatgaaggagaggctttcaattgcgacattccacaacgtcaaactagatggagcagttggtcctataccatgcctggttaccccggagacccctgcattgttcaaaacagttggagccgcagagtatttcaagcatttgttttctcgaaagctccatgggaagtcataccttgattccatgaggatatag

SEQ ID NO: 306 - DNA, 1173 bp, Chelidonium majus
atgactgcaaagttgcagagagatagtagagagagagagagagaggagagagttagaaaagaggcttcaatggatcagacaacaaagtcagtgagaataggaacttgtttgctagtaccaagcgttcaagagttggccaaacaacactttgtaaaagtcccacctcaatatatatgcccaaatcaagacccagctccgatcttctctcaaactctcgaaactcattccctttttgttccaactgttcctatcatcgatttgcagagattgctatctcaagaaccacatggtgacttggaattggggaggctggactctgcttgtaaggactggggtttctttcagttggtaaaccatggaatcaactcttcattaattgagcaagtaaaatcagaggttcaagatttcttcagacttccaatggaagaaaagaaaaagttttggcagaatgaaggagatattgaaggatttggacagaagtttgttgtatccaaagaacagaaacttgattggtcagacatgtttttcatgatcactcttcctctacattcaagaaagcctcatttacttccaaagctacctctacctctaagggttaccatagagtcctactcagaagaattgaaaaggctaaccatgactctagtagagctgatagcgaaatctctacagattgagccgaagttgatgacagagttatttgaagatggaaggcaagcaatgaggatgaattattatcctccttgccctcaaccggagctcgttatgggcataccgcctcactcggatagcgttggtttgactatcctccttgaactcaatgaaattgaaggattacagattaaaaaagaagggatgtgggttcccattaaaccgatacccggtgctttgttggtgaacattggagacatgttggagattgtgactaatgggatctaccagagtgttgagcaccgggcgacagtgaactcactgaaggagaggctctcgttagcgacattctacagtcccggtctagaaagagagataagtccagcacctagcttaattaccccacagacccctgctttgttcaagagcattggggttgggaattatctgacgaagacgaggtttaacaaagaccaactccatggaaaattacttcatagcttgaggaatgttactggataa

SEQ ID NO: 307 - DNA, 1080 bp, Cocculus trilobus
atgaaagttggttctctcccagtaccaaatgtacaagatcttgcaagtaagaaattgaaggaggtccctgatagatacattcagcgggaaccagagtcagaacatgtttcatttgagatgtctgatcaagttccagtgattgatcttgaaaggctcctcgatgatgaacccttcatctattctgatgaaatggccaagtttcatttggcctgcaaagattggggcttcttccagttaatcaatcatggcgttgatgaagaattgctaaagaagatggttagcaatgtagaggagttcttcaagttgccattagaggagaagaaagcttatgctcagctacctgacgaccttgaaggttatgggcaagcttttgtggtgtctgaagagcagaaacttgaatggtcagacattctcctcctccgtaccctccctgtttctataagaaacttgcggttttggcccgagaaaccctcttctttcagcgaaactcttgacaagtatgcatttgcgatggaaaaagtaacattcttgttgttgaatttgattgcaaagaatttgggagttgaacctaagatggtgacaagcatatttgaggatggaatacaaggagtaagttcgaattattacccaccatgcccagcaccagagaaggttttgggcatctctccacactcagatgcctctatgataactcttctcattcaaaacaatgaactcccagggcttcaaatcagaaaaaatggcaattgggtccccatcaagcccatcccaggtgccttcgttgtcaatattggagatgcgattgagataatgagcaatggcttgtataagagtattgaacacagggctgtgatacacccggataaagaacgcatatcgatagctgggtttcaagacccaaggagtggagtccttgttgggccactgccggagctcttaaagaagaaaaatgttggtgcaaattacaagactgtgaactttgatgagtatttaaggcagtacatctctgctaaacttgatggcaagaccatgctggatctggtaaagttggagaaacctgaaattcaagaaggggcttga

SEQ ID NO: 308 - DNA, 1080 bp, Cocculus trilobus
atggatcagaaggcccaagtaacagtgacgctgggcagctctcttctagtgcccaacgttcaggagatggccaggaaagctctcaacaccatccctgaacggtacatacgcgacgatttagagccacacttcgtaacgatatctgatcccactttgcttccaagtgttcccatcatcgatatgaaggctctgcttgaaggggaactcgtggattctgagttggaggaattgcactcggcttgtaaagactggggcttctttcagttagttaaccacagtgtaagcggatctttggtggagaaagtaaaagttgggattcaagaattcttcaatcttcccatagaagaaaaacagaagtattggcaaaaaccaggagaggtggaaggatttggacaagcctttgttgtttcggaggaacaaaaacttgattggggagacctgtttttcgtgctcacacagcccgcgtacctaaggaaaccccacttattcccattgctccctcaacctttcaggggaatattggaagaatattcaattgaattgaagaatcttgctaacaaggtcttggaaatgatggccaaagctctaaaaatggaagatgaggagatgaaattgttatttgaagatggtatgcaatcaatgaggatgaactattaccctccatgccctcaaccagagcaggtcatcggccttacaccccactcagatgctgttggtttaaccattctcctccaagttaacgaaatggagggtctccagataagaaaagatgggatgtgggttcctgtgaagccactgccaaatgcattcattgtgaatgttggagacgttttagagattgttaccaatgggatttaccgcagcatcgagcatcgagccgtggtgaactcatcaaaggagaggctctcggttgcaacattttacaatccgagaatagatggagaaatgggtccagcacctagcctcatcaaatcggattccctggcactatttagaagaataagcgtacaagactacttcaagggattatttgcccgagagctggttggaaaatcatatctcgatagcatgcgaatttga

SEQ ID NO: 309 - DNA, 1095 bp, Eschscholzia californica
atggagataacacaaaaagaaataaagttgggaaagtctttgttagtaccaagcgttcaagaaatggtgaaacaacccatagcagagatcccacctcgatatttacaaccagatcaaaacactcctaacactagtagtgatgtttctttgcctcaactctctgttcctatcatagatttagagagtttgctaactccaggatcagttggagacttggaactggataggttggattctgcttgcaaagaatgggggttcttccagttgataaaccatggagttagttcttcactggtcgagaaagtacaattagagactcaagatctttttaggcttccaatgatagaaaaaaagaaatattggcagactgaagaggaagttgaaggatttgggcaggcctttgtggtatctgaagagcagaagctggattgggcagacatattttacttgactactcttcctatccatggaaggaaaccccatttatttccaaagctccctcttccttttagggacacattagatagctattcattggaattgaaaagtctagctatgaccctcataaaagtaatggcaaaagctttacaaattgaaacaaaggtgattgaagagttatttgaagatgggttgcagagtatgagaatgaactattatccaccttgtcctcagcctgacttggtcattggcctcaaatcacactctgattcagttgctctgactattctccttcaacttaatgaagttgaaggacttcaagttattaaagatggaaaatgggttcctattaaacctctgtcaaatgcttttattgtcaacattggagacattcttgagattttgaccaatggaatttaccgtagtgtccatcatcgggcaatagtgaactcaacaaaagaaagactatcaattgctacattcctcaaccccaacccagaaggagaaataagtcctatcgggagcctaattactccaagcacccctgcattgttcaaaacagttggagttaagcaataccttcaagacttgtttactcgagagcttgatggaaaatcataccttgattgcatgaagatagatggaaacactacttaa

SEQ ID NO: 310 - DNA, 1089 bp, Eschscholzia californica
atggatatctcacaaaaggaagtgaagttcaggtctttgttagtaccaagcgtccaagaaatggttgaagaacctataggagagatcccatctagatatttacaacctggtcaaaacactcctatcattactactgatgtttcactctctgttcctatcatagatttagagagtttgttaacaccaggctcaattggagatttggaattggagaagttggattctgcttgcaaagaatggggcttcttccatttgataaaccatggagttagttcttcaatggtggaaagagtacaattagaaactcaacattttttcagacttccagtggtagaaaagaagaaatactggcagagtgaggaggaagttgaagggtttggacaaacatttgtagtatctgaagagcagaagcttgattgggcagacgtattttacttaactactcttcctgtccatgcaaggaaaccccatttatttcccaagcttcctcttcctttcagggacacattagaaagctattcacttgaattgaaaagtctagctatgactctattaagagttatggcgaaagctttacaagtcgaaacaaaggagttagaagagttatttgatgaagatgggttccagagtatgaggatgaattattatcctccatgtcctcgacccgacctagtcgttggccttagaccacactctgattcaacggctctaacaattctccttcatgtcaatgaagttgaaggactacaagttattaaagatggcaaatgggttcctattaaacctcttccaaatgctttccttgtcaacattggagatgttcttgagattttgaccaatggaatttatcgcagtgtggagcatcgggcaacagtgaactcaacaaaagaaaggctatcgactgctacattcctcaacccgaaactagaaggagaaataagtcctataaagagcctaattactcccaacaaccctgcattattcaaaacaattggagttaagcaattttaccaagacttagttatgagagagcttaatggaaaatcacaccttgatttcatgaagatagagagcaacaacactgcctag

SEQ ID NO: 311 - DNA, 1107 bp, Glaucium flavum
atggagacagctaaaaagccaataataataggaggttctttgctagtaccaagtgttcaggagttggctaaacagccccttgttcaagtaccaactcgatatgtacggtctgatcaagactcgcccactctttctgatgacatatccaccattccaacagttcctgttattgatttgcagtgtttgctatcaccagaagccattggagattcagaattggagaagcttcattctgcttgtcaagaatggggtttctttcagttggtaaaccatggagtcagcccttcattggtagagaaagtgaaaatggagattaaggatttcttcagactaccaatggaagagaaaaataagtattggcaagaggaaagacaagtcgaaggatttggacaggcctttgttgtatccaaagagcaaaaactcgattgggcagacctcttcttcatggtcactcttcccctccatgcaaggaagcctcatctatttccgaagctccctctaccgctgagggaaactttagaattctactcatcagaattgaaaatactaaccatgactctcttaaagatgatgtgcaaagcactacaaattggaactaaggagatgacggagctgtttgaagatgggatgcaatcaatgaggatgaattattatcctccttgccctcaacctgaactcgttataggcctcacaccgcattcagattccactggtcttaccatactccttcaactcaatgaaatggaaggactacagatacgaaaagatgggacatgggttccagttaaacctctaccaaatgctttcatagtaaacattggagatgctttagagattgtgactaatgggatctaccgtagcgtcgaacatcgggcgatggtgaactcgatgaaggaaaggctctccgttgggacattccacggccctagactagaagatgaaataggtcctctacctaacctgattaatcctgacagacctgcaatgttcagaagggttcgggttgaggagtattttaagaaattatttactcgagcactcgatggaaaatcattcattgattctatgaggattgaaatgggatgtgcagaagctaagcctgcttaa

SEQ ID NO: 312 - DNA, 1107 bp, Glaucium flavum
atggagacagctaaaaagccaataataataggaggttctttgctagtaccaagtgttcaggagttggctaaacagccccttgttcaagtaccaactcgatatgtacggtctgatcaagactcgcccactctttctgatgacatatccaccattccaacagttcctgttattgatttgcagtgtttgctatcaccagaagccattggagattcagaattggagaagcttcattctgcttgtcaagaatggggtttctttcagttggtaaaccatggagtcagcccttcattggtagagaaagtgaaaatggagattaaggatttcttcagactaccaatggaagagaaaaataagtattggcaagaggaaagacaagtcgaaggatttggacaggcctttgttgtatccaaagagcaaaaactcgattgggcagacctcttcttcatggtcactcttcccctccatgcaaggaagcctcatctatttccgaagctccctctaccgctgagggaaactttagaattctactcatcagaattgaaaatactaaccatgactctcttaaagatgatgtgcaaagcactacaaattggaactaaggagatgacggagctgtttgaagatgggatgcaatcaatgaggatgaattattatcctccttgccctcaacctgagctcgttataggcctcacaccgcattcagattcctctggtcttactatccttcttcaactcaatgaaatggaaggactgcagatacggaaagatgggagatgggttccagttaaacctctaccaaatgctttcatagtaaatattggagatattttggagattgtgactaatggaatctaccgtagcgtcgagcatcgggcaacagtcaactcgatgaaggaaaggctctccattgcgacatttcacagccctggactagaagacgaaataggtcctatagctaacctgattacccccgacagacctgcaatgttcagaagtgttagggcggaggagtatttcaagaaaagatttactcgagcactcgatggaaaatcattcattgattccatgaggattgaagcaggatgtggagaaggtaagcctacttag

SEQ ID NO: 313 - DNA, 1107 bp, Glaucium flavum
atggagacaactaaaatgccaagctcttatgtgccagtaccaagtgttcaagagttagctacacagattgatgatcttgttcaaataccagctcgatatgtacgctctgatcaagaatcatccactatcttttctgatgagatatccaccaatattccatcagttcctgttattgatatgcagtgtttgttatctctagaaactattaatggagtctctgatgaattggataagcttcactttgcttgtcaagaatggggtttctttcagttggtaaatcatggagtcagcactgcattggtagagaaagtaaaatcggagattcaagatttctttaaacttccaatggaagagaaaaaaaaatattcgcaaaaggacggaggagttgaaggatttggacaggtctgtgttgtatctgaagagcaaaaacttgattgggctgacatcttcttcatgttcactcttcctcttcatgcgaggcatctatttccagagctccctctacctctgagggaaaccttagaatcttactcatcagaattgaaaagtataaccatgactctcttaaggatgatggccaaagcactacaaattgagactaaggatatgacaaagctacttgaagatggggtgcaatcaatgaggatgaattattatcttccttgtcctcgaccggagctcgttataggccttacaccgcattcagatgccactggtctaaccattctccttcaactcaatgaaatggaaggtctagaaatacgaaaagatgggagatggattccaattaaacctctaccaaatgctttcatagtaaacattggagatatattggagatcgggactaatgggatctatcgtagcgtcgagcatcgggcaacagtgaactcaacaaaggagaggctctccattgcgacgttccacaaccctagtcttcaagacgaaatatgtcctttacctaacctcattacctctgacagacctgcaatgttcagaagtattatgactgaggagtataacaccaaactattgactcgagcactcgatggaaaatcattacttgattctttgaggattgaagcgaaatgtgaagatgatggtaattaa

SEQ ID NO: 314 - DNA, 1077 bp, Glaucium flavum
atggagacagctaaaaagccaataataataggaggttctttgctagtaccaagtgttcaggagttggctaaacagccccttgttcaagtaccaactcgatatgtacggtctgatcaagactcgcccactctttctgatgacatatccaccattccaacagttcctgttattgatttgcagtgtttgctatcaccagaagccattggagattcagaattggagaagcttcattctgcttgtcaagaatggggtttctttcagttggtaaaccatggagtcagcccttcattggtagagaaagtgaaaatggagattaaggatttcttcagactaccaatggaagagaaaaataagtattggcaagaggaaagacaagtcgaaggatttggacaggcctttgttgtatccaaagagcaaaaactcgattgggcagacctcttcttcatggtcactcttcccctccatgcaaggaagcctcatctatttccgaagctccctctaccgctgagggaaactttagaattctactcatcagaattgaaaatactaaccatgactctcttaaagatgatgtgcaaagcactacaaattggaactaaggagatgacggagctgtttgaagatgggatgcaatcaatgaggatgaattattatcctccttgccctcaacctgaactcgttataggcctcacaccgcattcagattccactggtcttaccatactccttcaactcaatgaaatggaaggactgcagatacgaaaagatgggacatgggttccagttaaacctctaccaaatgctttcatagtaaacattggagacatgttggagattgcgactaatgggatttaccgtagcgtcgaacatcgggcaacagttaactcattgaaggaaaggatctccattgcgacgttccacaatcctaatcctgaagatgaaatatgtcctctatctaacctcattacctctgatagaccagcaatgttcgaaagtattcgagctgaagactataccaagaaattattgactcgagcactcgatggaaaatcattacttgattctttggaggattga

SEQ ID NO: 315 - DNA, 1089 bp, Hydrastis canadensis
atggaggaaccaaagctaagctatggaagttcaattctggtacccagtgtccaggagttagccaaacaggccttagcttcaccaccaccacggtacataaagccccatcaagaccctcccattatctcctactctagtttgattcccccaattccagttattgatatgcagaaattgctttatggggaagacatggactctgaactggagacactgcactcagcaagtaaagaatggggtttcttccagctagtgaaccatgatgttaacaccatattggtggagaaagtaaaacatgagattcaagagttcttccaactcccattggaagaaaagaaagcttattggcaaaaagaaggtgaagtggaaggatttggacaagcattcgttgtgtcaaatgaacaaaaacttgactggggagacatgtttttcatgctcacccttccaatctatgcaagaaagccccacttactcccacaactccctttaccttttagagacaccatggatacttattctttggaatcgaaaaacctagccatgaaaattttagagataatggaaaaagctctaaagatggaagtaaatgagatgacaaatttgtttgaggatggaatgcagtcaatgaggatgaattattatccaccgtgtcctcaaccagagttggtcattggtcttacacctcattcagatactgcggccttaaccatcctccttcaagttaatgaagtggaaggccttcaaatcagaaaagaaggaatgtggattccaattaaacccctcccaaatgcttttatagtaaacattggtgacatgttggagattattactaatgggatctaccgtagcattgaacaccaagcaactgtgaactcagagaaggagagactttcaattgctacattctacagtcctagacataatgtagaaatgggacctgcacaaagcttggtcacaccccaaactcctgcattatttagaagaattggggtggaagagtactccaaagggctattttctagagtgcttgatggaaaatcttatctcgatgtcatgaggactgaaaatgggaaaaataactctaattag

SEQ ID NO: 316 - DNA, 1089 bp, Hydrastis canadensis
atggaggaaccaaagctaagctatggaagttcaattctggtacccagtgtccaggagttagccaaacaggccttagcttcaccaccaccacggtacataaagccccatcaagaccctcccattatctcctactctagtttgattcccccaattccagttattgatatgcagaaattgctttatggggaagacatggactctgaactggagacactgcactcagcaagtaaagaatggggtttcttccagctagtgaaccatgatgttgacaccatattggtggagaaagtaaaacatgagattcaagagttcttccaactcccattggacgaaaagaaatttttttggcaaagagaaggtgaattggaaggatttggacaagcattcgttgtgtcagatgaacaaaaacttgactggggagacatgtttttcatgttcacccttcccatctatgcaagaaagccccacttattcccacaactccctttaccttttagagacaccatggatacttattctttggaattgaaaaatctagccatgaaaattatagggatgatggagaaagctttaaaaatggaagtaaatgagatgacaaatttgtttgaggatgggacgcaatcaatgaggatgaattattatccaccatgtcctcaaccagagttggtcattggtcttacacctcattcagattctgtgggcttaaccatcctccttcaagttaatgaaatggaaggccttcaaatacgaaaagaaggaatgtggattccaattaaaccccttccaaatgctttcatagtaaacattggagacattttggagatggttactaatgggaaatattgtagcattgagcaccaagcaactgtgaactcagtgaaggaaagactttctattgctacattctacagtcccagacataatgtagaaattggacctgcacagagcttggtcacaccccaaactccagcattatttaaaagaattgggatggaagggtacttgaaagggttatttactagacagcttgatggaaaatcttatctcgatgtcatgaggattgaaaatgggaaaaacaactctaattag

SEQ ID NO: 317 - DNA, 1089 bp, Hydrastis canadensis
atggaggaaccaaagctaagctatggaagttcaattctggtacccagtgtccaggagttagccaaacaggccttagcttcaccaccaccacggtacataaagccccatcaagaccctcccatcgtctccaactctactttgatacccacaattccagttattgatatgcagaaattgctttatggggaagacatggactctgaactggagacactgcactcagcaagtaaagaatggggtttcttccagctagtgaaccatgatgttgacaccttattggtggagaaagtaagacatgagattcaagagttcttccaactcccattggacgaaaagaaatttttttggcaaagagaaggtgaattggaaggatttggacaagcattcgttgtgtcaaatgaacaaaagcttgactggggagacatttttttcatgttgactcttccaatctatgcaagaaagccccacttattcccacaactccctttaccttttagagacaccatggatgcttattctttggaatcgaaaaacctagccatgaaaattttagagataatggaaaaagctctaaagatggaagtaaatgagatgacaaatttgtttgaggatgggacgcagtcaatgaggatgaattattatccaccgtgtcctcaaccagagttggtcattggtcttacacctcattcagatactgcggccttaaccatcctccttcaagttaatgaagtggaaggccttcaaatcagaaaagaaggaatgtggattccaattaaacccctcccaaatgcttttatagtaaacattggtgacatgttggagattattactaatgggatctaccgtagcattgaacaccaagcaactgtgaactcagagaaggagagactttcaattgctacattctacagtcctagacataatgtagaaatgggacctgcacaaagcttggtcacaccccaaactcctgcattatttagaagaattggggtggaagagtactccaaagggctattttctagagtgcttgatggaaaatcttatctcgatgtcatgaggactgaaaatgggaaaaataactctaattag

SEQ ID NO: 318 - DNA, 1071 bp, Jeffersonia diphylla
atggagactgagatgattaacacctgggagtttggaggttctctcccagtagagaacgtccaggctcttgctgctaaggagttaaaagacatccctgatcgctacatcagaccagaattacaatcagatcacgtttctattgatgagtctagagaaatcccagtgattgatctatccagactcttagatgaacaagtttctcttgatgaattggccaagtttcattcagcctgcgaaggctggggcttctttcagttgataaaccatggtgtatctgaggaaataattaataagatgaagattgacgtacaagacttctttagtttaccattggaggagaagaaagcttgttcacaagtagccaccagtatccaaggctatgggcaagcctttgttgtgtctgacgagcagaagcttgactgggcagacatgcttttcattcttccattacctgtccgtgaaagaaacatgagattctggcctaataccccaacttcatttagggaaacattggacaagtattcattagagttgcaaagagttacagtttcccttataggtttgatggctaggaacttggctgttgaaccagaaaaattaaccaacatgtttgagaatggtttacaaggggtgcggattaattattacccgccatgtcctcaggcagacaaggttttaggcctctctccgcactctgatgctgttgccttgactttgctcattcaagtcaatgatgtcgaaggattgcagatcaggaaaagagggaattgggtccctgttaagcctattccaggtgcttttattgtcaacattggcgatataatggagataataagcaatggaaagtacaagagcatcgagcatagggctattattaaccccaaaaaggaacgcttatctattgctgcatttcatagtccgaatcttagcacactgatcggcccccttgcagatctagtaaacgaaagtggagagcattataagacaataatgtttgaggattacttgaagcacattgtttctagtaagcttgatggtaagagcacactggactacttgaaattagattaa

SEQ ID NO: 319 - DNA, 1056 bp, Jeffersonia diphylla
atggggacagaagtgcctatgccaatgtcggtagagaatgtccaggatcttgctaccaagattcttgatgtaatcccttcaaggtacattcgacccgaactaatgactgacgtggtatctatcgacgaggagtctatgataccaattattgacttaagcaaactcactgatgatcatgtctctcaagctgaactggaagagttccacttggcttgtcaaaactggggcttctttcagctcataaaccatggactcaaggaggatgtattagagaagctgaagatggatgtgactgaattttttaatctaccaatcgaggccaagaaggaattctcccaagaaccggggcagatggaagggtatgggcaggcgtttgtgttctctgatgagcaaaagctagattggggagacatgctttaccttgttacccaacctgaggctgcaagaaggatgaaactttttcctacctgcccttctacattcagggatacaattgctaactactcattggagtcggaaagggttaagatgtgcgtgttaggcgtgatggcaaagaatctagggattgaacgagaaaaattcacaaacacgtttgagggaggaatacaaagcatgaggtttaattactacccgccatgtcttgaggaggataaggtcttgggcatttctccacactctgatgccactggcattacacttctagttcaagttaatcaagtccatggattgcaaatcaggcacgaaggtcgttgggtccctgtggtactggcaactgacgctattctggttaacattggggatgttctagagatactaaccaacggaaaatacaagagcatcgagcacagagttgtcataaacaaaaataaggaacgtctttcagtcgctgccttccatgaagtgaacgaaaatgcaacagtaggacctattccggaacttgtcaaggatggagaagagtgttatcagagcttcagctttgatgaatacgcagagctcctgattggtgagaaactcgacgggaagagcctcattgaacgcatgaggttgaagaaatga

SEQ ID NO: 320 - DNA, 1089 bp, Mahonia aquifolium
atggcacctacaccgatttctcccctacaggttggtcacatcattgatgtccaagaattgagaaaggttcgaacaaagacaatccctaggaggtacatccgtgcggtggcagaacgaccaatctctgctgctacatcaaccatgcacattccggttatcgacctctcaaagcttattgaaggcaatagtgatcagtcccaaatggagctatcaaagctggcctcagcatgtgaacagtggggcttttttcaggtcattaaccatgggattgacatatcaatgatggagaacatggaaaaagttggcaaggagttcttcatgttacctgtggaggagaaacagaagtatcccatggcacctggaaccattcaaggatatggtcaagcatttgtgttttcagaggatcagaaattggattggtgcaatatgttagctctaggaattgaaccccatttcataagaaacccaaaactttggcctacaaacccagctaacttcagtgaaacactagaaacatactccgaagaggtaaggaagctatgtcagaacctactgaggtttatagccacgagcttgagcttgagggatgaaacgttcaacgatatgtttggggtgccagtgcaagctgtgaggatgaactattatccaccttgtcagaggcccgaccttgtcttgggtctcagcccacattcagatggaagtgccctgacagttttgcaacaagctgcaggtagttcagtaggccttcaaatccttaaggatgacaaatgggtgccagtgcaacccgttccaaatgcactagttgttaacattggggatactttagaggttctaacaaatgggaagtacaagagtgtagaacacagagcagtgacacacaaggacaaggacagacttacaatagtaacattttatgccccagactatgagatcgaacttggacctctgcctgaatttgttagtgagaaccgaccatgcatgtatagaaaatacaaccatggagaatacagtcgacattacgtcaccaacaaattacaagggaagaaaactctggactttgctaggattcaaaccgagttctcagcttaa

SEQ ID NO: 321 - DNA, 1065 bp, Mahonia aquifolium
atggaagtagggttggctgagaccttgcaatacaatgtccagcttcttgccagtaagaaacttgatgtgatcccctcaaggtatatccgacctgaacttgcggctgatatcatatgcatggataaggcatcggtgattccagtgatcgatttcagcaaactatgtgatgatacattttctcaggatgaattggaaaagtttcatctggcttgccaagattggggcttctttcagcttgttaaccatgaagtcccgaaagaggttttagaaaaagtgaaaacagatttaactgaattttttaatctgccaattgaagaaaagatggcatgccaacagccagggcaagaagaagggtatggcctagtcgtcatgttttccgatgagcaaaagctagactggggagacatgattggcattgttacccaacctgaaactacaagaaatgtaaatgtttggcctaattctcctcttactttcagggaaacgattgcccagtactcgttagagttgcaaaaaattaagacgtgtatattgggtttgatggcaaagaacctggggattgaaccagagaagttcacaaacatgtttgagggtggaatgcaaagcatgagaatcaattactacccgccatgccaaaaggatgataaggttttgggcctctctccacactccgattccaatggtattacatttttaattcaggttaacgatgttcaaggattacaaattaggcacgaagggtgttgggtcccagttgtattatctactgatgccattctagttaacatcggtgatgtccttgagatattaaccaatggaagatacaagagtgttgaacacagagttgttataaacaagaacaaagaacgcctttctgtcgctgcatttcatgaattaaacgaaaatgagacaattgaacctcttcaagaactcatcaaagagggagaagataagtgttatagaagcttaagttttgctgaatatcaaaagctcgaatctagtcactatcttagtcactatcttgatgggaagaccctcattgaaaaaatgaagttgaagaaatga

SEQ ID NO: 322 - DNA, 1062 bp, Menispermum canadense
atgagcagcaacacggggcattttggtggctctctacctgtagagaatgtgcaggctcttgcttctcaggaattgaaggaagttccttctcgatatgtccgacccgagttggcattcgatgttgtttccattgatgaatctcttcaaatccctgtgattgatcttttcagacttactgaccaacgatacgcccgtgatgaattggccaagcttcattctgcttgtgaagactggggcttcttccagctgatcaatcctggagtccctcatgacatgattgaaaatatgaaggctgacactgaagagttctttaagctaccattggaggtgaagaaagcttactcacagctgcccaactcaattgaaggctatggccaagcctttgtggtctctgaagagcagaagcttgactggggagacatgcttttctttttttgccaacctcttaatgaaagaaacatgagaatttggcctaaccatcctgattctttcagggaaacactggacaaatattcagcagagttgcaaagagtcgcgctttgtttgttgggttttctggccaagaacttggggcttgatccagagaagttcataaacatgtttgagaatgggatgcaaggggtgaggatgaactactatccaccatctccacaggcagaaaaggttttgggcatctcaccgcactccgatgctgacagcctaactcttctccttcaagtaaatgaagtgcaaggactgcagatcaggcacaatgggatttgggtccccattgagcccattccgggtgctctcatagtcaacattggagacgtcattgagataatgagcaatgggaagtataagagcattgagcacaggtccatcgtgaacacgaagaaggagcgactctccattgctgcgtttcacaccacgaaggctggtactactataggtccaatttcggatcttgtgaaggagaacggtgcaaattacaggaccgtaagcgatgaggatttccttaggcaagttatcaccaataaacttgacggtaaaagcgtattagaccacatgaaattaaaatag

SEQ ID NO: 323 - DNA, 1071 bp, Menispermum canadense
atgagctcgttggagacgatgagagaatccactgtgcctctggcggtggagaacgttcaggttcttgcgtccaagaacttgaaagaaattcctctcagatacattcgaccagaacacgaacttgaaatctcctccattaacgaaattacggaagcttcgtcgtcagatgttccagtgattaatctaagcaggctcacggatgatgatgaacagttttaccaggaagaaatgggcaagtttcatttcgcctgtcaagaatggggcttcttccagctggtgaaccaaggagttgcagaggatgtgatggagaagatgataagagatgtgagtgagttcttcaagttgccgtttgaagagaagaaggcgtgttctcaagatgcggatcaaatggaaggctatggacagtcatttgtgttctcagaagagcaaaagctggattggggtgacatgctttttctcttcacacaacccctgctttcaaggaacttcaaggaatcagtgagcaggtactcatctgagatggaaagaatcaaaacaattttagttggtcagatggggaagaacttggggatcaatcaagaggagttcacaaacatgttcaataatggggtccaaagcatgagattcaattactacccaccatgcccacaagcgtcaaaggtgttgggcgtctctccacactctgacgccactggcctcactgttcttctccaactcaatcaggttcaaggattgcaaatccgccacgacggccaatgggtccctgtcaatatacttcctgacgctcttctagtcaatatcggtgacattcttgagatactgagcaacgggaggtacaagagtatagagcatagagtggttataaacaaggagaaagaacgcatgtccgtggcagtgtttcatgaaacaaataaaagtgctgaaactgggccwcttccagagctattattgaacaacgaaggagaaacagacaagtataggagtgtaagttttgaaggattcgtgaacttgttttcttctcgtaaacttgatgggaagagcctcgtagatttcatgaagttgaagaaataa

SEQ ID NO: 324 - DNA, 1107 bp, Menispermum canadense
atggctgatgagaaggcaaaggaagcagtaccagtgacgctgggcagttctctcctggtacccagcgttcaggagatggcaaggaaggctatcagcacagtcccagaacggtacgtacgcaacgatctagacccacctttctccaccaaccccactttgcttcccacccttccaaccatcgacatgaacagtttgcttgatggggaatccgcggattctgagttggagaagctgcacttggcttgcaaggattggggattttttcagttacttaaccatggagtaagcgcatctttggtggagaaagttagaattgggattcaagatttcttcaacatgacaattgaagaaaaacaaaagttttggcaaaaaccaggagaggtggaaggatttggtcaagcctttgttgtttcagaggaacaaaaacttgattggggagacttgtttttctgtaccacacagcctgcatatcagcgaaagccccacttattcccaatgcttcctcaacctttcagggaaacattagaagaatactcattagaattgaagaatctcgcaatgactttaatagaaatgatggcaaaagctctaaaaatggatattgaagacatgaagttgctatttgaagatggaatgcaagcaatgaggatgaactattatcctccatgccctcaaccagaccaagtcattggccttacacctcattctgatgctgttggtttaacaattctccttcaagtaaatgaaatggaaggactccagataagcaaagatggaatgtgggttcctgtaaagccactaccaaatgctttcattgtaaacattggagacattttagagattgttacaaatgggatttaccgtagcatcgagcatagggcaacagtgaacgcatcaaaggagaggctctcaattgctacattctacaatccaaagtttgatggagaaatgggtccagcacctagcttaatcaagaaggattcaccaccattctttataagaatgagagtagaagagtacttcaaaggattatttgctcgagagcttgttggaaaatcgtatctcgatagtatgcggatcagatacgaaaaaagtggcatagtatag

SEQ ID NO: 325 - DNA, 1071 bp, Menispermum canadense
atgactgttggtcctctcacagttccaaatgtgcaggatcttgcaagtaacaagctgaaagacatccctcatagatacattcagcgtgaaccagaatctgagcatgttttgtttgagatttctgatgaagttcctctaattgatctccaaaagattctccatgagtccttttcttctgatgaaatggccaagcttcatatggcctgcaaagactggggcttcttccagataatcaatcatggtgtggatgaagaattaatcaagaggatgttgaatgatgtggaagagttcttcaagttgccattagaggagaaaaaggcatatgctcagctacccaatagctttcaaggttatgggcaagagcttgtggtgtctcaagagcagaagcttgactggtcagacatgctcgtccttcacacccttccaatctctcgtagaaatatgaagttttggcctataaacccagcttctttcagagaaacacttgacaagtatacgatggagacagagagagtcacattgtgtttgttgagtttgatggctaagaacttgggggtggaggcagagaaggtgacaagcatatttgaggatggaatacaagcggtgaggatgaattactacccaccttgctcacaagcagataaggttttgggcatctctccacactctgatgcctctatcattactttgctcattcaaaacaaccaagtgcctgggctgcagatcagaaaagatggcaactgggtccccatcaaacccatccccagtgcctttattgtcaatgttggagatgtaattgagataatgagcaatggcttgtacaggagtgttgaacacagggccgtcatagacccagaaaaagaacgcatatcaattgctggatttcaagacccaaggaatggagtccttgttgggccactcccagagctcatggagggaaataaaggcgcaaattataagacagtgagctacgatgagtacttgaggcagtatctttctgctaaacttaatggcaaaagcgtgttggatctcttgaaattggagaaatgtgagattaaagaaagggtttaa

SEQ ID NO: 326 - DNA, 1080 bp, Nandina domestica
atggggagtgagcaaatgaatgatgagcaaagggtgttcggaggttctcttccagttgattatgttcaggttcttgctgccaagaagttaaaagaaatcccagatcgatatattagatccgaattagaatttgaagttgtttccattgatttgtccaacaaaattccggtgatcgatctaggcaaactccttgatgaacaatttcgtcgtgatgaaatggctaagttgcattcagcctgtgaagactggggcttctttcagttgatcaatcatggggtatctgaggaaataattcagaaaatgaagactaactcacatgaattcttcaatcttccattggaagaaaagaaagtctacgcgaacctccccagcagtaatgaaggttatggacaagcatttgttgtgtctgaagagcagaagcttgactgggttgacatgtttttcgttactacgttacctctccacgaaaggattacgcgattgtggcctaataaccctacttctttcagggaaacattggaccagtactcattagagttgcaaagggttacaatcagccttgcaggtttcatggcaaataacttgggggttgagcccgagaaattgactaacatgcttgagaatggatcacaaggtataacgatgaattactatccaccatgcccacatgcagataaggtcataggcctttctccgcactctgatgcttgtgctataactttgctcattcaagtcaatgaagtagaaggtttgcagattaggaaaaatgggaattgggttcctattaaacccattgcaggtgctttcatcgtcaacattggtgatacaatggagatattaagcaatggaaaatataagagcaatgtgcacagggctatcgtacacccacaaaaggagcgcatctcagtcgctgcatttcatcgtccaaacttaagtgccatgattgatcctctttcagagcttgtaaaggaaagtggaaagcattacaagaccattctcttccaggattacttaaagcattattttgcttctaaactcgattgtaagagcgccttggatttaattaaattagataattga

SEQ ID NO: 327 - DNA, 1116 bp, Nandina domestica
atggagagtaagcaggtgtataaatcaaggatgttgggaggttctctaccagttgagaacgttcaggctcttgccagtaagaagttacaagaaatacccgatcgatatataagaccagaattagaattcgatgttgtttccgttaatttgtcgaatgaagttccagtaatcgatctacgcaaactccttgatgaacaatttggttgcaacgaaatggctaaattgcattcagcgtgtgaagactggggcttctttcagttgatcaaccatgaggtgtcggaggaaataattgaaaaaatgaagatcgacttacaagggttcttcagtcttccattggaagaaaagaaagcatatggacaactagctaacagcaacgaaggttatggacaagccttcgttatatccgaagaacaaaagcttgactgggctgacaggctttacatcgtgaccttaccagtagaggaaagaaacatgagattttggcctaataccccaacatcatttagggaaacgttggataagtactcggtagagttgcaaagagtcgcagtttgtcttgtaggtttgctggccagtaacttgggggttgaaccaaaaaacttgactaacatgtttgataagggttttcaagcagtaaggatgagttactatccgccatgtccatgtgcagataaggttataggcctttcgccacactctgacgcagttgccctaactttgctcattcaagtaaatgaagttgaaggtttgcaaattaggaaaaatgggaattgggttcctattgaacccattccaggtgctttcatcgttaacattggtgatgcaatggagataataagtaatggtaaatataagagcattgagcacagggccgtcattcacccacaaaaggaacgcatctcggtggctgcatttcatggcccaaatcttaatgccatgattggtcctctttcgaatcttggaaaggaaagtggagagcattacraggaggtaggaggcgggcaaaatatggggaagactgtagcaattgttgtaggtggggttgcagcagtggggtttgcacttatttgtctaatgtttctaagatctttgatgaagaaacatgatgattattaa

SEQ ID NO: 328 - DNA, 1116 bp, Nandina domestica
atggcacctgcagcaattccttccctcaaggtcggccacatccacgatgttcaagagctaagaaaggctcgacgtaggaccatcccaaagaggtatgtacgcgatatagctgaacgaccaatcacttctgtgacctcaaccatgcacattcctgtcatcgacctttcaaagcttattcaaggtgatatagatcaatcccagaccgagttactgaagcttgcctcggcctgcaaggactggggcttcttacaggtcattaaccacgggatcgacgtatcgttgttagagagcatagaaaaagtgaccaaggagttcttcatgttacctttggcagagaaacagaagtatccaatggcaccggggaccgttcaagggtatgggcaggcgttcgtgttctcagaggatcagaagctggattggtgtaacatgttagctctaggaattgagccccatttcataaggaacccaaaactctggccaacaaaaccagctgagttcagtgagacactggaaatgtactctacagaaataaggaaactctgcaagaacctgctgagattcatagccatgagcttgggattgaaagacgacgtgttcaacgggatgttcgggacaccagtgcaggctgtgagaatgaattattacccaccatgtccgaggcctgaccttgtattgggtcttagccctcactcagatggaagtgccctgacagtgttgcaacaagctgcaggcagctcggtgggacttcaaatctacaaggatgatacatgggtccctgtccaacctgttccgaatgcacttgttattaacattggagacaccctagaggttcttacaaacgggatatacaagagtgttgaacacagagcagtgacacacagggacaaagaccgccttactctcgtgaccttctacgccccaagctacgagatggaactcggccctctccccgaattcatcgatgaaaaccgaccttgcatgtatagaaaatacaatcatggggaatacagtcgacactatgtcaccaacaaattagaagggaagaaaacgttggacttcgccaagattcaaaccaagtgtcggcttaagtccccaccacgcttcaacttgacacta

SEQ ID NO: 329 - DNA, 1062 bp, Nandina domestica
atggagagtgcaaatgagttgggaggttcaatcccagttgagaatgttcaagctcttgctgccaaggacttaaaagaaatcccacatcggtacatcagacctgaattagaatctgatgttgtttccattgataagtccagagaaattcccgtgattgatctaggcaaactcctcgatgaacaatttgctccggaagaattggctaagttgcattctgcttgtgcagactggggcttttttcagttgatcaaccatggagcatcagaagaaataattgagaaaatgaagcacgacatacaagagttctttaggcagtcattggaggtgaagaatgctttctcacaacttcctaacagcgtagaaggctatggacaagcctttgtagtctctgaagagcagaagcttgactgggctgatatgctttaccttgagaccttgccaatttctcaaagaaaagtcaatctctggcctactacccctacttccttcagggagacactggacaaatactcactagagctgcaaagacttacaatttgtcttataggtttgattgccaaaaacatggagattgaaccccaaaaaatgactaacatatttgagaatggtacgcaaggagtaaggatgaattattaccctccatgtccttgtgcaaatcaggtcttaggcctttctccacattcagatggtagcggcctaactttgctcattcaagtcaacgaagttgcaggtttgcagattaggaaaaatagggactgggttcctgttaaacccattgcaggtgcttttattgttaatatcggagatgcagtcgagatatttagcaatggaaaatacaaaagcatcgagcacagggctgtcattaatcctgagaaggaacgcctctcaattgctgcatttcatgaccctaatctaagcaccatgatcggtcctctcccagaacttgtgaaggaaaatggagaacgttacaagactataaagtataaggattacataaagcaagttatggcaagtaagcttgatggtaaaagctcattggactccctgaaattacaaaaatga

SEQ ID NO: 330 - DNA, 1074 bp, Nandina domestica
atggagagtgagatgaacaaggcaattgaggtgggtggttcgatcccagttgataatgttcaagctcttgctactacggagttgaaagaaattccacatcgatacatcagacctgaatttgaatctgatgtagtttccaatgacaagtccggaaaaattcctgtaatcgatctatgtaagctccttgacgagcaattcagtcatgatgaattggctaagttgcattctgcctgtgaagactggggctttttccagttgatcaaccatggagcagcagaagaaataattgagaaaatgaagattgacatacaagagttcttcaggcagccattagaggtaaagaaagcttattcacagcttcccaacagcatggatggttatggacaagcctttgtggcgtctgaagagcagaagcttgactgggctgatatgcttttccttacgtgcttgccaatttctcagagatatgtcacactttggcctactatccctacttctttcagggagacattggataaatactcactagaattgcaaagagttaccacttgtcttataggcatgatggccaagaatttggggattgaaccacaaaaattgactaacatttttgagaatggtttacaaggagtaaggatgaattactacccaccatgtcctcaggcaaacaaggtcattggcctttctccacattcagatggtagcggcctaacgttgcttattcaagtcaatgaagttgaaggtttgcagattaggaaaaatggggactgggttcctgttaaacccattgcaggtgcttttattgtcaatatcggtgatgcagttgagatattgagcaatggaaaatacaagagcatcgagcacagggctgtcattaatcctgaaaaagaacgcctctcaattgctgcatttcataatcctaatctaagcaccatggttggtcctctcccagaacttgtgaaggaaaatggagaacgttacaagactatgaagtatgaggattacgtaaagcaagttatagcaagtaagcttgatggtaaaagctcattggacgcggtgaaattagagaaatga

SEQ ID NO: 331 - DNA, 1074 bp, Nandina domestica
atggagagtgagacgaaagaaccgaaaccgctcgggggttctctccccgttgagaatgtccaagctcttgctaccaaggagttaaaagaaatccctcatcggtatatcagacctgagatagaatctagcgttgtttctgttgacaagtccagagaaattccagtgatcgatctaggcaggctagtcagtgagcaattttcgtcggatgaaatggctaagttgcaatcagcctgtgaagactggggcttctttcagttgagcaaccatggggtgtcggaagaaataattgagaaaatgaagatcgacttacgagatttcttcaatcttccgttggaggaaaagaaagcttgttcgcaattacccaacaacactgaaggctatggacaagccttcgttgtgtctgatgagcagaagcttgattggtcagacatgcttttcatcatgaccttacctgtccctgaaaggaacatgagattttggcccaagaacccctcttctttcagggaaacaatggacaaatactcaacagagttgcatagagttacagtttgtctaacaagtttgatggctaagaacttgggggttgaacccgaaaaattggctaacatgtttgagagtggatcacaaagtgtaaggatgaattactatccaccgtgcgcacatgcagataaggttataggcctttctccgcattctgatgctgttgggctaactttgctcattcaagcaaatgaagttgaaggtttgcagattaggaaaaatgggaattggattccagttaaaccaattgcaggtgctttcgttgtcaacattggggatgtactggagataataagcaatgggaaatataagagcattgagcacagggctgtggctcatccagagaaggaacgcctctcaatcgctgcatttcatggcccaaatttcaatgccatgatcggtccactttcggatcttgtaaaggaaagcagagagcattataagaccataatccacgaggattacgttaaacaaatttttgcttctaaacttgatggtaagagcacattggatttcatgaaattggacaaatga

SEQ ID NO: 332 - DNA, 1065 bp, Nandina domestica
  misc_feature (54)..(54): n is a, c, g, or t
atgaataaggcaaaggagttgggtggttcaatatcagttgataacgttcaagcncttgctaccaaggagttgaaagaaatcccacatcggtatatcagacctgaattagaatctgatgtagtttccattgatgagtccagagaaattccggtgatcgatctatgcaaactccttgacgaagaattcgcttctgatgaattggctacgttgcgttctgcctgtgaagactggggtttttttcagttggtcaaccatggagcatcagaagaaataattgcaaagatgaagattaacatccaagagttttttaggcagccgttggaggttaagaaatctttctctcaactacccaacagcatggaaggctatggacaagcctttgtggtgtccgaggagcagaagcttgactgggcagatatgctttttcttgtttcctcgcctatctctgaaagaaatttcacattttggcctactaaccctacttccttcagggaaacattgagcaaatactcattggagttgcaaagagttacagttcgtcttgtacgtttcatggctaagaacttgggggttgaaccagacatgttggctaacatgtttgcaaatgatggttcacaaacgatacgaatgaattactacccaccatgtccacagagggacaaggttttaggcctttctccgcattcagatggtagtggcctaactttgctcattcaagtcaatgaagttgaaggtttgcaaataaggaaaaatggcagctgggtacctgttaaacctgttgcaggtgctttcattgtcaatatcggtgatgtcatcgagataatgagcaatgggaaatacaagagcatcgagcacagggctgtcattgatccagtaaaggaacgcctctcaattgctgcatttcatggcccgaacctcaacaccatgactggtcctcttccagatcttgtaaagaaaaatgaacaacgttatatgactgtaaactatgaggattacgtagaacaacttgtatcatctaagcttgatggtaagagcgcattggattcaatgaaattagagaaatga

SEQ ID NO: 333 - DNA, 1077 bp, Nigella sativa
atggcaacctcaaatccagtgaagtatggaagttctaaactggtaccttgtgtccaagagttggccaagcagcctatggtgacgccacctgcaaggtacatcaggttggaccaagagccttccttcgtatctgctcttcctcttgatgcagttccagttatcagcatgcagaaattgttgtatggcgatagcatggaacttgaactgcaaaggctgcattctgcttgtaaagagtggggtttcttccagttggcgaaccatggagttcccgagatattggttgaaaatattaaaaaggaaattcaggaattttttgaacttccatttgaagagaagaaaaagttttggcaaagtgaaaatgaagtagaagggtttgggcaagcttttgttgtgtctgatgaacagaagcttgactgggcagatatatttttcatcaacactcagcctataaattctaggaagcctcacttgtttccaaaccttccattaccttttaggagaactttggatgattactcactggagttgaaaaatcttgcaatgaagatcttgggatggatggagaaggctctaaagattgaggggaaagagataacagagttgtttaaggagggagtacaatcaatgagaatgaactattacccaccatgtcctgaatcagataaggttattggtcttacccctcattcagattctataggtttaaccatccttctgcaggttaacgaaatggaaggccttcaggtcagaaaagaagggaaatggattccaattaaacctcttccaaatgctttcatagttaacattggggacattttggagatagttacaaatggagtctaccacagcatagagcatcgggcaaccgtaaacaaagtaaaagagagactctccattgctacattctatagtcccagatttgaagcagagatgggacctgcaaagagcttggttacagatcaaactccagctatgtatagacgaattatggttcacgagtacttccgccaattcttttctcgagagcttggtggaagatcatttatcgaggatatgaagattgaaaatgaagattga

SEQ ID NO: 334 - DNA, 1101 bp, Nigella sativa
atggggaacaagacaaacatgagagagtttggtggttcattaccagttcagaacgtccaggctcttgcttctcaacctctcaatcaaatcccacctcgttaccttcgccctgaactcctctccgacacagtagttactgctactgatagtgatgaatcactcaaaattccggtcatcaacttccgccgactgctcctggatcaacaacagcaagctgatgatgatggttcttataatgaaatggacaagttccatgcagcctgccgtgattggggcttctttcaattaatcaaccatggggtagctgacgaagtgattgagaagatgaagatgggcacagaggggttttttagattgccattagaagaaaagaatgtttactcacagctacccaacaacattgaaggctatggtcaagcctttgtggtgtctgaagaccaaaagcttgactggggagacatgctcttctttctgtcccagcctctccatgatagaaccctcagattttggccgaacacaccgtcttcttacagggaaacattggataaatactcagctgaattgcaaaagcttgcagttagtctagtagagatgatggcaagtaacttggggattataccagaaaaattaacagacatgttcgggatagatggttctcaagggttaaggatgaactactacccaccatgtcctcatgcagacaaggttatcggcctttctccgcactctgatggtactggcataactctgctcttacaggtcaatcaagttcagggattgcagatcagaaaaaatggaaattggcttcccattacgccgattccaggtgctttcatcgtcaacattggcgatataattgagattatgagcaatggggcatacaagagcattgagcatagggctgtcattaacccagagcaggaacgtctctcgattgccgcatttcatggaccaagacttggcactccaattggacctctcccatgtattgtgaaggaagatgaaatgaaatacaaaacagtaagccatgaggattatctgaagcagatgatcaatcagaagcttgatggtaagagtgtattggatctaatgaaattatga

SEQ ID NO: 335 - DNA, 1155 bp, Papaver bracteatum
atgttcaaaaatcaaccccgaaacattttcttagttcccgatcctccctccatcgtgttctctaattcccctttgtttcattcaatcaatcaatccatggaggtctttgtatcaggagttcaaaccttatctgaaactggtgtcactcatgttccatctcaatacatacaaccaccacagaatcgacctcatcaaccaacaataacttcttcctcagattctctcaacatacccattattgatttatccaatttcaatccgcaacattcaaacgatgtacgtacagaacttggtcgagcttgtagtgattggggtgcttttcaaattacaaatcatgggatttcaaattcactaatcaaagatatcattgacgtaggtttaactttctttaatgagtgttcaattacagagaaatctaagtattcttgtgatccaaattctgctgcttctgaaggatatggaagtcgaatgctagtcaacgaagatagtgtcttggattggcgagattattttgatcatcatacttttccattatctcgtcgaaaccctaatcgatggccagattttcctactaattatagaggagttgtggaggaatacagtaatcaaataaaggaacttgcgcttaagttgatgagcatgatatctgaaagtctaggtttacaatcttcatgcattgaagatatagttggagaggtttatcagaatttaactatcagttattaccctccttgtccgcagccagaacttactctggggttacagtcacattctgatataggtgccataactcttttgatacaagatgatgttgggggtcttgaggttttgaaggacgacaaatgggtaactgttcagcctgtgtctgatgcaattgttgtcattttggctgaccaattcgagattatgacgaatggcaagtaccgaagcgcagtacatcgagctgtaacgaattctcatcgagcgcggctctcagtgggaacatttcatgacccaggtaagattaggaaaattgcaccagctgctcagcttgtagacaaggacactctagccagatataaagaagttgtatatggagaatatgtttcaaattggtactccaaaggccccgaaggaaaaagaaatattgattccctattacttaaccaacagtag

SEQ ID NO: 336 - DNA, 1110 bp, Papaver bracteatum
atggagacaccaaaatcaatcaagcttggtggttctttgttagtacctagtgttcaggaattagcccaacaatcgtttgcagaagtccctgctagatacgtacgcgacgatctggagccgttgactgacctctctggtgtgtctatgattgatcaaactatacctgttatcgatttgcagaaattacaatctccagtaccaatcattcgagagctagaatcagaaaagctacactctgcttgcaaagaatggggtttctttcaggtggtaaaccatggagttgacattttattggtggagaaaacgaaatcagaaattaaagatttcttcaatctcccaatggatgagaaaaagaaattttggcaggaagaaggagatattcaaggatttggacaagcctttgttcaatcagaagaccaaaagcttgattgggcagatatatttttgatggtcactcttcctcgacatacaaggaacccaaggctatttcccaaattgcccctacctctcaggaatacgatggactcctactcatcgaagttgagtaaactggcctcgactctcattgagatgatgggaaaggctttacatatggagactagtgtgctggcagagttgtttgaagacgggagacaaacaatgaggataaattactatcctccttgccctcaacccaaggacgttatcggcttaacaccgcactctgatggtggcggtttgacaatccttcttcagctcaacgaagtggatggattacagattagaaaagaaaagatatggattcccatcaaacctctaccgaatgcctttgtagtcaacattggaaatattttggagataatgactaatgggatttaccgtagtgttgagcaccgagcaacaatacactcaacaaaggagaggctctcagttgcagcatttcataatcctaaagtaggtgtggaaataggtccaatagttagcatgatcacgccagagtcacctgccttgttcagaacaattgagtatgacgattatggtaagaagtacttttctcgtaaactcgatggaaaatcatcccttgacttcatgaggataggagaaggtgatgaagaaaataaggccacgtga

SEQ ID NO: 337 - DNA, 1101 bp, Papaver bracteatum
atggagacaccaaaattaattaagctaggcggttctttgttggtacccagtgttctggaattgaccaaacaatcgcctgcggaagtcccagctcgatacatacgcaatgatctggagccgatgactgatctttctagtgcatctttgacggatcaaacgatacctgttatcgatttgcagaatttactttctccagaacccgagttagaattggagaagcttcactctggttgcaaagaatggggtttctttcaggtgatgaaccatggagttgacattttattggtggagaaagtgaagtcagaaattcaaggtttcttcaatctcccaatagatgagaaaaataaattttggcaggaggaaggagatttggaaggatatggaaaagcttttgttcattcagaagacgagaagcttgattgggcagatatgtttttcattctcactcaaccacaatatatgaggaagcccagagtgttccccaaactccctctgcgtctcagggagacaattgaatcttactcattggagttgagtaaactgggcttgactctccttgatttgatgggaaaggctctacaaatagagactggggtcatgtcagagttatttgaagacgggagacaaacaatgaggatgaattattatcctccttgtcctcaacctgagcacgtaatcggattaacaccacactcggatggtggtgctttgacgatcctccttcaacttaaccaagtggatggattacagattagaaaagaagagatatgggttcctattaaaccactacctaatgcctttgtagtcaacattggagatattttggagataatgagtaatggggtttaccgtagcgtggagcaccgagcaacaataaactcatctaaggagaggctctcagttgcaatatttcagagccctaaacatggcacagagataggtccgatacttagcatgatcacaccagaggcacctgcattgttcaaaacaattccgtacgaggactatttgaggaagttcttttcacgtaaactcggcggaaaatcatttgttgactccatgaggataggagaaagtgatgaagacaacaacactgcatga

SEQ ID NO: 338 - DNA, 1101 bp, Papaver bracteatum
atggaaacacaaaaacaagaaaatttcggtgcttctttgtcagtacctaatgttcaggaattggccaaacaatcgcctgaacaagtcccagataggtacatacgaagcgatcaggactcgtcgactaacatctcttgcccgtctatgacagatcaaatacctgttatcgatttgcagagtttactatctccagatcccatcattggtgagttagaattggagaggcttcactcagcttgcaaagaatggggtttctttcaggtggtaaaccatggagttgacaatttattggtggagaaagtgaaatcagaaattcaaggtttcttcaatcttccaatggatgagaaaaagaaattttggcaggaggaaggagatttcgaagggtttggacaagcctttgttttttcagaagatcaaaagcttgattggggagatgtgtttttcattcttactcaaccccaacatatgaggaagcctaggctgttccccaaactccctctacctttcaggaaaacaattgaatcttattcattggagacgaacaaattaagcatgaccctccttgagttgatggaaaaggctctaaaaatagagactggggtcatgacagagttgtttgaaggcgggatacaaagaatgaggatgacttattatcctccttgtcctcaacccaagcatgtaatcggccttacaccacattcagatcccgacgctttgacgatcctccttcaactcaacgaagtggatggtttacagattagaaaagaaaagatatgggttcccattaaacctctatccaatgcctttgtagtgaacattggagatattttggagataatgagtaatgggatttaccggagcgtggaacaccgagcaacagtaaattcaacaaaggagagactgtcagttgcaacatttcatagccccagaaaagatacggaaataggaccgatactgatcacaccagagacacctgccctgttcagaacatctggttttgaggattattttcggaagttctttgctcataaactcaacgggaaatcattccttagctccatcaggataggagaaaccgatgaaggcaacaacgctacatga

SEQ ID NO: 339 - DNA, 1140 bp, Papaver bracteatum
atggaggcaccaaaactgataatgctaggtggttctttatttgtacctagtgttcaagaattagccaaacaatcacttgcagaagtcccagttcgatacgtacgcgatgaccaggacacgctaggtaataatattaatatcactcctatgtccatgatagatcagtcaatacctgttatcgatttggagaaattactgtcaccagaacccatcgttggtgagttagaattggagaggcttcactctgcttgcaaagaatggggtttctttcaggtggtaaaccatggagtcgacagtttattggtagagaaagtgaaatcagaaattgaaggttttttcaagctcccaatggacgagaaaacgaaattttggcaggaagaaggagatatagaaggatttggacaagtctttgttcattcccaagaccaaaagcttgattggggagatatgtttttaatgcaaactcttcctcgacatacgaggaagcctaggctatttcccaatctccctctacctctcaggcagacaattgaatcctactcatcagagttgagcaaacttgtcttgactctcgttgacttgatgggtaaggctctacaaatggaatctggggtcttgacagagttgtttgaaaacgggatacaacgaatgaggatgaattattatcctccttgtcctcaaccagaacaggtcatcggcttaacaccacattcagatgttggcggtttgacgatcctccttcaactcaacgaagtggatggtttacagattaaaaaagataaagtatgggttcctattaaacctctagctaatgcatttgtagtgaacgttggagatgctttggagattatgagtaatgggatttaccgtagcgtggagcaccgagcaacaataaactcaacgaaggagaggctctcaattgcaacatttcataacccaagagcagatagggaaataggtccaatacctagcatgatctcaccagagacacctgccttgttcaaaacaactgggtatgaggaatattttaagaaattcttttctcgtaaactcgaagggaaatcatttcttgactccctaaggataagagaaggcgatgaacactgcggtcgattggatgtgaaagggccatgtaattga

SEQ ID NO: 340 - DNA, 1098 bp, Papaver bracteatum
atggagataccaaatccaataaagattggtagttctttgcttgtacctagtgttcaggaattggccaaacaatcttttgcagaagtcccggctcgatacattcgcaatgatgtcgacccattgatcactaaactctctgatgtatctttgatagatcaaacagtacctgttattgatttgcagaaattactatctccagaacccatcgttggtgagttagaattggaaaggcttcactctgcttgcaaagaatggggtttttttcaggtggtaaaccatggagttgacaatttattggtggagaaagttaaatcagaaattcaaggtttcttcaatcttccaatggaggagaaaaagaaattctggcaagaggaaggagattttgaaggatttggacaaatgtttgttcaatcagaagaacaaaagcttgattggggagatatgtttttcattctcactcaaccccaacatatgaggaagcctaggctattttccaaactccctctgcctctcagggagacaatcgaatcctattcattggagttgattaaactaggcttgactattatcaagttgatggagaaggctctgcaaatagatgccggggttatggcagagttgtttgaagatgggatacacacaatgaggatgaattattatcctccttgtcctcagcccgagcacgtcatcggcttaacaccacattcagatggtggtggtttaacgattctccttcaactgaacgaagtggatggattacagattagaagagaaaatatatgggttcccattaaacctctacctaatgccttcgtagtgaacattggagatattttggagattttgagcaatgggatttaccgtagcgtggagcaccgatcaacagtaaacgcgacaaaggagaggctctctgttgcaacctttcagaaccctaaacaagaatccgtaataggtcccaacatgatcacaccagagagacctgctttgttcagaaaaattgtgtacaaggattatatgaaaaaattattttcccggaaactcgatggaaaatcattccttgactccttgaggataggagaaggtgatgaaagaccataa

SEQ ID NO: 341 - DNA, 1089 bp, Papaver bracteatum
atgggtgaagtcgatgcggcctttgttcaagctctagaacataggccgaaccctaacaatatagtcgaggcaggtggaatcccactgattgatctttccccgctgaatgatttttgtcattctaatgatgagaattcagcacatgatagtgctaggcatactgatctagtaacaaagataggcagagcatgcaaggagtggggattcttccaagttttcaatcacggggtatcgtctgatctccaacaaggagttgaggcggccgtgaagaaattctttgatttgtcatcagaggagaagagaaaagtgaagagagatgaggtaaatccaatgggttattatgacaccgagcatactaaaaacgtccgagattggaaggaggtgttcgacttcacggtgaagaacccgaccttgttacctgcttctcaccatctggaagatcaagaactgcaggagttgaggaaccaatggcctgactacccccctgagttaagggaggtttgtgaagaatatgctagtgctttggagaaactctcgtttgagttactgaaattgatagcactgagtttggggttgccagagaagaggttgaatggttactttaacgatgaccatactagtttcatccggttcaatcactacccgccatgtccggaaccacatttggctcttggtgttggtcgacataaggatgctggcgcactaacagttcttgcccaggatgatgttggtgggcttgatgtaaaacgaaaatcagatggcgaatgggtcagggttaaaccaattccaggttcttacattgtcaatgttggtgatattattcaggtttggtgtaacgataagtacgaaagcgcagaacatagagttacggttaattcaaaaagggagagattctctatccctttcttcttcaacccctcgcaccacgtaatggtaaagccattggaagaacttgtagactaccagaacccatctaaatataaggaatataattgggggaagtttttcaagacaagaaaaatcagcaatttcaagaaacttgacgccgaaaacatccagatataccacttcaaaaggtctctggtttaa

SEQ ID NO: 342 - DNA, 1050 bp, Papaver bracteatum
atggaaacactaaaaacagtgaagccaggtggttctttgtttatacctaatggtcaagaactggccaaacaatcgcttgaagaagtatacgtaggaaatgatcaggacacgatgttattgattggtcaaacaataccggttattgatttgcagaaattactttctccagagcctatcactggagacatggaattagacaagcttcactctgcttgcaaagaatggggtttctttcaggtggtaaaccatggagttgatattttattggtggagaaagtgaaatcagaagttcacgatttcttcaatatcccaatggacgagaaaaagccattttggcaggaagaaggagacctggaaggattcggacaagtttttattacatcagaagaccagcagcttgattggggagatatgtttttcatggtcactcttcccaaacacatgaggaagcctcggctatttctcaaactccctctacccctcagggagacaattgaatcctactcattgaagttgagtaaacttggcgtgactcttgtagagttgatgggaaaggctttacaaatggaggatcggattatgtcagagttgtttgatgacgggagacaaacaatgagaatgaattattatcctccttgccctcaaccggagcaagtcatcggcttaacaccacattcagatcctggtggtttgacgatcctacttgaactcaacgaagttaatggattgattagaaaagaaaatatatgggttcccattatacctctacctaatgcctttatagtgaacattggagatattttggagattatgagtaatgggatttaccatagcgtggaacaccgagcaacaataaactcaacaaaggagaggctatcagttgcaatgtttaatagccctaaagtagatacggaaataggtccgatacatagcatgatcacacccgagacacctgccttattcagaacaattgggtatgatgaatatttgaagatattcttttcccgtaaactcgacggaaaatcactccttgagtccatgaagatatga

SEQ ID NO: 343 - DNA, 1131 bp, Papaver bracteatum
atgagctatgaaagtttaccaccaaaagtcgtcgtgccatcggttcatgaactgattaaagaaaagatcactgagatcccgaatccttacatccgtacaagttgtgttgatcatgaagatcatcacactgatcaatccacggctgaccacaacataccggttatcgacgtacaaggtctactctctggagaatcagtattggcagattctgaatttgagaaacttcattctgcttgccaagactggggcttctttcaggtggtaaaccatgggattagctctctagtgattgcgaatttaaaatcggaaatgcgcaacttgtttgaacttccattagaggaaagaaagaagatatgtcaggaaccaggagatccgatggccgagggatttgggcaactgtttattgtttcagacgatcagaaacgtgattggtcagacaccttctacttaacagctctaccaactaaattgagaaagccacagttatttgccgggataccagtactaatgagggagtcgttggaagcttactcttcaggattaaaagacgtgaccatgattctcctaggaaagatggcgaaagctataaagatggattctgatgagatggaagagttattcaatgattgtttgcaaagaatgggactaaattactatcctccttgtcccaagtcagagcaggtcataggtttatcaccacactcggatgctggtgctttgtcgattgtccttcagctcaatgaaaccgaaggccttcagattcgtaaagatggaaaatgggtaactgtaaaacccatccctggtgcacttatagtcaatcttggagacatgattgagattctgagcaatggtgcctatccaagtattgagcatagagtaatggtgaatccagcaatagagaggctttcaattgccacattccatgcgaccaatccagatgcagaattcggccctgcacttagcttgattgatcctccacataaaccagcattattcagaagagagaccgtggagaaattctatacaaacttctttgctaataaacttaatgggaagaccactaacctggatttcatgaggattcaaaatggcgatcagtccagtagattgatatcaggataccggccataa

SEQ ID NO: 344 - DNA, 1140 bp, Papaver bracteatum
atggaggcaccaaaactgataatgctaggtggttctttatttgtacctagtgttcaagaattagccaaacaatcacttgcagaagtcccagttcgatacgtacgcgatgaccaggacacgctaggtaataatattaatatcactcctatgtccatgatagatcagtcaatacctgttatcgatttggagaaattactgtcaccagaacccatcgttggtgagttagaattggagaggcttcactctgcttgcaaagaatggggtttctttcaggtggtaaaccatggagtcgacagtttattggtagagaaagtgaaatcagaaattgaaggttttttcgaactcccagtggacgagaaaaagaaattttggcaggaagaaggagatatagaaggatttggacaaatctttgttcattcagaagatcaaaaacttgattgggccgatatgttttacatgctcactcttccgccaaatatgaggaagcctaggttatttcccaatctccctctacctctcaggcagacaattgactcctattcatcagagttgagtaaacttgtcttgactctcgttgacttgatgggtaaggctctacaaatggagtctggggtcttgacagagttgtttgaaaacgggatacaacgaatgaggatgaattattatcctccttgtcctcaaccagaacaggtcatcggcttaacaccacattcagatgttggcggtttgacgatcctccttcaactcaacgaagtggatggtttacagattaaaaaagataaaatatgggttcctattaaacctctacgtaatgcatttgtagtgaacgttggagatgctttggagattatgagtaatgggatttaccgtagcgtggagcaccgagcaacaataaactcaacgaaggagaggctctcaattgcaacatttcataacccaagagcagatagggaaataggtccaatacctagcatgatctcaccagagacacctgccttgttcaaaacaactgggtatgaggaatattttaagaaattcttttctcgtaaactcgaagggaaatcatttcttgactccctaaggataggagaaggcgatgaacactgcggtcgcttggmtgtgaaagggycatgtaattga

SEQ ID NO: 345 - DNA, 1089 bp, Papaver bracteatum
atggaaactccaaaactgatgaagctgggtggttctttatttgtacctagtgttcaagaattagccaaacaatcacttgcagaagtcccagctcgatacgtacgcgatgaccgggacatggtaggtaatattattaatgtcactcctatgtctatgatagatcagtcaatacctgttatcgatttggagaaattactgtcaccagacctcatcgttggtgagttagaattggagaggcttcactctgcttgcaaagaatggggtttctttcaggtggtaaaccatggagtcgacagtttattggtagagaaagtgaaatcagaaattgaaggttttttcgaactcccaatggatgagaaaaagaaattttggcaggaagaaggagatgcggaaggatttgcacaattctttgttcagtcagaagaccaaaagcttgattattcgggagatatgtttttcatgctcaatcttccccagcatatgaggaagcctcggctatttctcaaactccctctacccctcagggagacaattgaatcctactcattgaagttgagtaaacttggcgtgactcttgtagagttgatgggaaaggctttacaaatggaggatcggattatgtcagagttgtttgatgacgggagacaaacaatgagaatgaattattatcctccttgccctcaaccggagcaagtcatcggcttaacaccacattcagatcctggtggtttgacgatcctacttgaactcaacgaagttaatggattgattagaaaagaaaatatatgggttcccattatacctctacctaatgcctttatagtgaacattggagatattttggagattatgagtaatgggatttaccatagcgtggaacaccgagcaacaataaactcaacaaaggagaggctatcagttgcaatgtttaatagccctaaagtagatacggaaataggtccgatacatagcatgatcacacccgagacacctgccttattcagaacaattgggtatgatgaatatttgaagatattcttttcccgtaaactcgacggaaaatcactccttgagtccatgaagatatga

SEQ ID NO: 346 - DNA, 1023 bp, Papaver bracteatum
atgggtagaactgtcaaggacttgactgatacaagtgatcttatatcaattccgtcagagtatgtattccctacaaatcctgaggatctcgaagaagcggagcagcagattcccataattgattactacctcctgacttccggttctcccgaacaacggtcacttatcatcgagaaccttcgaagtgcatgtctcgagtggggtttcttcatggtgattaatcatggtgtccctcagagtctaataaatgaaatgatgaatttgtgtctgggtttctttgatctaagtcccaatgaaaaatcggattatgttggaaaacatgttttgaatcctatcagatgtggaaccagttttaatacttcagttgaaaaaatttacttttggagagattatctcaagattcttgtgcacccagaatttcacgccccgctcaaaccacatgctttcagagatatttcatatgaatactgcaaaagatcaagagaagtagctaaggaattgcttaaagctatatcagagagtttaggccttgaagaagattatattgagaaggcattagaaaccaaatctggtttacaaatcttgattgtaaatctttatcctccttgcccacagccagaactcgccatgggtatgcctcctcattctgaccacggacttctcacactactcgctcaaaacgaaatcggtggattgcaaatcaagcataaaggaaaatggatcgctgcaaacgctttaccaaactcttttatggttaacattggtgatcacatggagatattaagcaatgggaaatataaaagcattttacatcgagttgcagtgaacactaaggctacaagggtaactgtggttactgcaaacggaccatctttggacgctgtagtaactccggctccagatttagttgattgcgagaactatcccccgttatatcgagggatgaaatatagggattatgtcgagcttcaacagagcaaccaacttgatggaaaatcatgtttggatcgtattcttgtttaa

SEQ ID NO: 347 - DNA, 1098 bp, Papaver bracteatum
atggagacaccaaaacttagggacttcggtagctttttgccagtacctagtgttcaggaattagctaaacaagttcttacagagatcccacctcgatacattcgcaccgatctagaagcgttgaataaactctcatgtgcgtctaatacagatcaaacagttcccatcattgatatgcagtgtttgttatcagcggaaccggagatggagttggagaagcttcattctgcttgcaaagaatggggtttctttcgggtggtaaaccatggagtcgacaacttagagagtgtaaaatcagagattgaaagttttctgaatcttccagtgaatgctaaaaacaaatatggacagaaacaaggagatgatcaaggatttgggtcacgctttgttttatcggaagaacaaaaactcgactggggagacttcttttacatggtcactcgtcccctctacttgaggaagccacacttatttcctgaactccccctaccactcagggagacaatagaatcctactcatcagaagtgagtaaactagctatggccctcttcgagatgatgggtaaagctctgaaaattgaaaccggagttatgacagaaatctttgaaggtgggatgcaagcaatgaggatgaattactatcctccctgccctagaccagaccttgtcatcggccttaacgcacactcggattttggcggtttgacaatcctacttcaacttaatgaagtggaaggattagagataagaaacaaaggggaatgggtttcagttaaacctttagccaatgcatttgtagttaacgttggagacgttatggagatattgactaacgggatctaccatagtgttgagcatcgggcaacaataaactcaagcaaggagaggctctcagttgcaacatttcattaccctaaactagagacgggaataggtccattaccttgcatgatcaccccaaaaacaccagccttgttcggaaggatcgagcggtatgagcttctcttaaggaaatattatgcacgtaaactcaatggaaaatcaactcttgactgcatgaggataggcaacggttttgaagacgataacactgcatga

SEQ ID NO: 348 - DNA, 1107 bp, Papaver bracteatum
atgagctatgaaagtttaccaccaaaagtcgtcgtgccatcggttcatgaactgattaaagaaaagatcactgagatcccgaatccttacatccgtacaagttgtgttgatcatgaagatcatcacactgatcaatccacggctgaccacaacataccggttatcgacgtacaaggtctactctctggagaatcagtattggcagattctgaatttgagaaacttcattctgcttgccaagactggggcttctttcaggtggtaaaccatgggattagctctctagtgattgcgaatttaaaatcggaaatgcgcaacttgtttgaacttccattagaggaaagaaagaagatatgtcaggaaccaggagatccgatggccgagggatttgggcaactgtttattgtttcagacgatcagaaacgtgattggtcagacaccttctacttaacagctctaccaactaaattgagaaagccacagttatttgccgggataccagtactaatgagggagtcgttggaagcttactcttcaggattaaaagacgtgaccatgattctcctaggaaagatggcgaaagctataaagatggattctgatgagatggaagagttattcaatgattgtttgcaaagaatgggactaaattactatcctccttgtcccaagtcagagcaggtcataggtttatcaccacactcggatgctggtgctttgtcgattgtccttcagctcaatgaaaccgaaggccttcagattcgtaaagatggaaaatgggtaactgtaaaacccatccctggtgcacttatagtcaatatcggagacatgcttgagattctgagcaatggtgcctatccaagtattgagcacagagtagtggtgaatccaacaatggagaggttttcaattgccacattccactcaaccaatccagatgcagaaattggccctgcacatagcttgattgatcctccacataaaccagcattattccgaagagagactttgaagaaatactatcaaaacttcttcgctcacaaacttaatggaaagaccacgaacttagatttcatgaggattcgaaatggcgatctatccagctga

SEQ ID NO: 349 - DNA, 1107 bp, Papaver bracteatum
atgagttcatcacctatggtcgtgcctttggttcgtgaattggttaaagaaaacatcactgaaatcccaaatcgatacatccgtcctactagtgatcttgatcatgagtatcatcatagtgatgacgactccactgcagctaagtacaatatacctgttatcgacgtggaaggaggactactctctggagaatcagtattggcagattctgaattacacaaacttcattctgcttgccaacactggggcttctttcaggtggtaaaccatgggattagctctctagtgattgcgaatttaaaatcggaaatgcgcaacttgtttgaacttccattagaggaaagaaagaagatatgtcaggaaccaggagatccgatggccgagggatttgggcaactgtttattgtttcagacgatcagaaacgtgattggtcagacaccttctacttaacagctctaccaactaaattgagaaagccacagttatttgccgggataccagtactaatgagggagtcgttggaagcttactcttcaggattaaaagacgtgaccatgattctcctaggaaagatggcgaaagctataaagatggattctgatgagatggaagagttattcaatgattgtttgcaaagaatgggactaaattactatcctccttgtcccaagtcagagcaggtcataggtttatcaccacactcggatgctggtgctttgtcgattgtccttcagctcaatgaaaccgaaggccttcagattcgtaaagatggaaaatgggtaactgtaaaacccatccctggtgcacttatagtcaatatcggagacatgcttgagattctgagcaatggtgcctatccaagtattgagcacagagtagtggtgaatccaacaatggagaggttttcaattgccacattccactcaaccaatccagatgcagaaattggccctgcacatagcttgattgatcctccacataaaccagcattattccgaagagagactttgaagaaatactatcaaaacttcttcgctcacaaacttaatggaaagaccacgaacttagatttcatgaggattcgaaatggcgatctatccagctga

SEQ ID NO: 350 - DNA, 1122 bp, Papaver bracteatum
atgagttcatcacctatggtcgtgcctttggttcgtgaattggttaaagaaaacatcactgaaatcccaaatcgatacatccgtactacctgtctcgatcatgaagaagatcatagtcaccgtgatgattatgactcggccgcagctaagtacgatatacctgttatcgacgtacaaggcggcctactctctggagaatccgtattagcagattctgaattggagaaacttcattctgcttgccagcactggggattctttcaggtggtaaaccatggaattagctctctagtgattgacaaattaaagttggaaatacacaacttgtttgaacttccattggaagagaaaaagaagatatggcaggaaccaggagatatggagggatttgggcagcagtttgtagtttcaaatgaacagaaacttgattggtcagacatgttctacataacagctctaccaactaaaatgagaaagcctcaattattttccaggataccattatcactacgggaagcattggaagcttactcatggggattaaaaaacctcaacatgattttactaggaaaaatggctacagctctaaagatggattctgatgagatggaagatttattcagtgactgtctgcaaaggatgaaaatgaattattatccaccttgtcctaaatcacaacaggttataggtttatcaccacattcagatgctggtgctttgtcgattgtcctccagctcaatgaaactgaaggccttgagattcgtaaacatggaaaatgggttcctgtaaaacccatccctggtgcacttgtagtcaatgtcggagacatgattgagattctgagcaatggtgcatatacaagtatcgagcacagagtaatggtgaatccaacaatagagaggctttcaattgccacattccattcaatcaatccagatgcagaatttggccctgcatgtagcttgattgatcctccacataaaccagcattattcagaagagagaccgtgaagaaatactataaaaacttcttcgctaacaaacttaatggaaagaccacgaacctagatttcatgaggattcaaaatggcgatcaatccagcagattgatatcaggataa

SEQ ID NO: 351 - DNA, 1104 bp, Papaver bracteatum
atgagcagctttgggagttcactaatagttccatctgttcaagagttggttaaaaaggagatcactgagatcccggatcgatatatccgtacaagtagcagtaatcttagtctcgataatgaaattcattacagcgactctgctgctcacgaaatacctgtaatcaacattggcagacttctttccggagagcaaacattggccgacaatgaattagacaaacttcactctgcctgcaaagattggggtttctttcaggtggtagatcatggagttagcttatccacaattgagaaaataaagttggaaacacataacctctttgaactcccactagaagagaaaaagaagttatggcagacaccaggtgaccatgagggattcgggcaactctttgttgtttcagatgagcagaaacttgattggtctgacatgttttttataaccatgctaccaactatattgagaaagcctcatttatttgcgggaatgccatcacctttaagggaggccttggaagactatgcattaggattagaaaaactgaccatgactattctggaacaaatggctaaagctctaaagatggattccaatgagatgagagagttattcagtggttgttatcaaacaatgagattgaattactatcctccttgtcctaaagctgagcaggtagtaggtatctcaccacactcggatgcggacgctttgacaattgtccttcagcttaatgaaacagaaggccttcagattcgcaaagatggaaaatggattccagtaaaacccatccacaatgcttttgtagtcaatattggtgatattatggagattgtgagcaatggtgtctatcgcagtattgagcacagggcagttgtaaattcaacaaaagagaggctttcggttgctgcattccactccgccaatttagatgcagagataggccctgcacatagcttgataagtcctccacataaaccagctttattccgaagagagtccgttgagacatactttaagaacttctttgcacgtaaacttgatggaaagtcttacctagcttccatgaggattgacaaagtgcatggggaacagtccagttga

SEQ ID NO: 352 - DNA, 1113 bp, Papaver bracteatum
atggaggcaccaaaactgataatgctaggtggttctttatttgtacctagtgttcaagaattagccaaacaatcacttgcagaagtcccagctcgatacgtacgcgatgaccaggacacgctaggtaataatattaatatcactcctatgtccatgatagatcagtcaatacctgttatcgatttggagaaattactgtcaccagaacccatcgttggtgagttagaattggagaggcttcactctgcttgcaaagaatggggtttctttcaggtggtaaaccatggagtcgacagtttattggtagagaaagtgaaatcagaaattgaaggttttttcgaactcccagtggacgagaaaaagaaattttggcaggaagaaggagatatagaaggatttggacaaatctttgttcattcagaagatcaaaaacttgattgggccgatatgttttacatgctcactcttccgccaaatatgaggaagcctaggttatttcccaatctccctctacctctcaggcagacaattgactcctattcatcagagttgagcaaacttgtcttgactctcgttgacttgatgggtaaggctctacaaatggagtctggggtcttgacagagttgtttgaaaacgggatacaacgaatgaggatgaattattatcctccttgtcctcaaccagaacaggtcatcggcttaacaccacattcagaagttggcggtttgacgatcctccttcaactcaacgaagtggatggtttacaaattagaaaagaaaagatatgggttcccattaaacctctatccaatgcctttatagtgaacattggagatattttggagataatgagtaatgggatttaccggagcgtggaacaccgagcaacagtaaattcaacaaaggagagactgtcagttgcaacatttcatagccccagaaaagatacggaaataggaccgatactgatcacaccagagacacctgccctgttcagaacatctggttttgaggattattttcggaagttctttgctcataaactcaacgggaaatcattccttagctccatcaggataggagaaaccgatgaaggcaacaacgctacatga

SEQ ID NO: 353 - DNA, 942 bp, Papaver bracteatum
atgtccatgatagatcagtcaatacctgttatcgatttggagaaattactgtcaccagaacccatcgttggtgagttagaattggagaggcttcactctgcttgcaaagaatggggtttctttcaggtggtaaaccatggagtcgacagtttattggtagagaaagtgaaatcagaaattgaaggttttttcgaactcccagtggacgagaaaaagaaattttggcaggaagaaggagatatagaaggatttggacaaatctttgttcattcagaagatcaaaaacttgattgggccgatatgttttacatgctcactcttccgccaaatatgaggaagcctaggttatttcccaatctccctctacctctcaggcagacaattgactcctattcatcagagttgagtaaacttgtcttgactctcgttgacttgatgggtaaggctctacaaatggagtctggggtcttgacagagttgtttgaaaacgggatacaacgaatgaggatgaattattatcctccttgtcctcaaccagaacaggtcatcggcttaacaccacattcagatgttggcggtttgacgatcctccttcaactcaacgaagtggatggtttacaaattagaaaagaaaagatatgggttcccattaaacctctatccaatgcctttatagtgaacattggagatattttggagattatgagtaatgggatttaccatagcgtggaacaccgagcaacaataaactcaacaaaggagaggctatcagttgcaatgtttaatagccctaaagtagatacggaaataggtccgatacatagcatgatcacacccgagacacctgccttattcagaacaattgggtatgatgaatatttgaagatattcttttcccgtaaactcgacggaaaatcactccttgagtccatgaagatatga

SEQ ID NO: 354 - DNA, 1149 bp, Papaver bracteatum
atgatgagtgcacaagattcttggcctgaaccaataacaagagttcaggcaatatcagaaagtggttcttctgttattccagatagatatgtcaaacctccctcagaaagacctaataccagtactacttcatccacagagttattaggtctgtcaatagatactgaaactagcagtaatgttgatgcttctgatctcaatatcccacttattgattttcaagggctacttgatgatgatgaggataatcatctggttctaccagatacgattctggatcaagtatgcatggcaagtaaaaactggggttttttccaaattgtcaatcacggggtaagtcctgagttaatggatcaagttcgagacgtatggcgacagttctttcatttaccatttgaacagaaacaagtttacgccaatacaccggcaacctacgagggttatggtagtcgattgggtgttgaaaaaggcgccattcttgattggaacgattacttttacttgcactatcttcctcaatctttgcaagatcctaacaagtggcctgctctacctttatcttgcagggaagtgattgctgaatactgcaagcagttggtgaaattaagtaagaaaataatgaagattttatcaattacccttgggttagaagaagattatcttcaaaatgcatttgaaggtggagaggaatttggagcttgtatgagagtaaatttctatccaaaatgtccacaacctgatcttgcacttggtctctcttcacattctgatcctggtggtatgactcttctcctccccgacgatgacgtcgtcggtctccaagttcgtaaagatgatacttggattaccgttaaatctgctccaaactcatttatcgttaacatcggcgatcaaattcaggtgctgactaatgcgatatacaagagcgtcgaacaccgggttactgtgaattcaatgaatgaacgcttatctcttgcattcttctataaccctagaggagatttaatcatacagccagctaaagagctcgtaacactagaacgaccagctctttattcgccgatgactttcaatgaatataggcgcttcattcgaacaatgggtacccgtggaaaattgcagcttgaatctatgaaatcaccacgttaa

SEQ ID NO: 355 - DNA, 1098 bp, Papaver bracteatum
atggagacaccaaaattagtgaagtcaagtggttcttctttgtttttatcaactagtgttcaggagttggccaaacaatcacttccagaagttcctgctcgatacatacgcactaatctggaaccgttgagtaatgtctccggtgattctcaatcagtacctgttatcgatttgcagaaattactttcttcagagccaatcattggagagttagaattggacaagcttcactctgcttgcaaagaatggggtttctttcaggtggtgaaccatggagttgacaatttagtgatggagaaaatcaaaactgaaattcaaggtttcttcaatctttcactggatgagaagcagaaattttggaagaaagaaggagatgcggaaggatttggacaaaattttattgaatcagaagaccaaaaacttgattggggagatacgtttgggatgttcactcttcccatacatatgaggaatcctaggctatttcccgagctgcctctacctctcagggaaacaattgaatcgtactcattggacgtgagaaaactagccttggctcttattggtttgatggaaaaggctctaaaaattaagactagtgcaatgtcagagttgtttgaggacggaggacaagcaatgaggatgaattattatcctccttgccctcaaccagaacacgtcatcggcttaacaccacattcagatgctggcggtttgaccatcctccttcaactcaacgaagtggatggattacagattaaaaaagacaaaatatgggttcccattaaacctctacctaatgcatttgtagtgaacattggagatatcttggagataatgactaatgggatttaccgtagcgtggagcatcgagcaacaataaactcatcaaaggagaggctctcggttgcagcatttcatagccctaaaggagatacattaataggtccaatggtcagcttgatcacaccagagacacctgcattgtttagaacaattgggtaccaggattatatgaagaaattcatgtctcgtaaactagatggaaaatcattagttaactccatgaggataggagaaggtgatgaagacaaataa

SEQ ID NO: 356 - DNA, 1083 bp, PSODIOX1
atggagacaccaatacttatcaagctaggcaatggtttgtcaataccaagtgttcaggaattggctaaactcacgcttgcagaaattccatctcgatacacatgcaccggtgaaagcccgttgaataatattggtgcgtctgtaacagatgatgaaacagttcctgtcatcgatttgcaaaatttactatctccagaacccgtagttggaaagttagaattggataagcttcattctgcttgcaaagaatggggtttctttcagctggttaaccatggagtcgacgctttactgatggacaatataaaatcagaaattaaaggtttctttaaccttccaatgaatgagaaaactaaatacggacagcaagatggagattttgaaggatttggacaaccctatattgaatcggaggaccaaagacttgattggactgaagtgtttagcatgttaagtcttcctctccatttaaggaagcctcatttgtttccagaactccctctgcctttcagggagacactggaatcctacctatcaaaaatgaaaaaactatcaacggttgtctttgagatgttggaaaaatctctacaattagttgagattaaaggtatgacagacttatttgaagatgggttgcaaacaatgaggatgaactattatcctccttgtcctcgaccagagcttgtacttggtcttacgtcacactcggattttagcggtttgacaattctccttcaacttaatgaagttgaaggattacaaataagaaaagaagagaggtggatttcaatcaaacctctacctgatgcgttcatagtgaatgttggagacattttggagataatgactaatgggatttaccgtagcgtcgagcaccgggcagtagtaaactcaacaaaggagaggctctcaatcgcgacatttcatgactctaaactagagtcagaaataggcccaatttcgagcttggtcacaccagagacacctgctttgttcaaaagaggtaggtatgaggatattttgaaggaaaatctttcaaggaagcttgatggaaaatcatttctcgactacatgaggatgtga

SEQ ID NO: 357 - DNA, 1095 bp, PSODIOX2
atggagacagcaaaacttatgaagctgggtaatggcatgtcaataccaagtgttcaagaattggctaaactcacgcttgcagaaattccatctcgatacatatgcaccgtagaaaaccttcagttacctgtgggtgcatctgtaatagatgatcatgaaacagttcctgtcattgatatagaaaatttaatatcttcagaaccggtaaccgaaaagttagaattggataggcttcattctgcttgcaaagaatggggtttctttcaggtggtgaaccatggagtcgatacttcattggtggataatgtaaaatcagatatccaaggtttctttaatctttcaatgaatgagaaaattaaatatggacagaaagatggagatgttgaaggatttggacaagcctttgttgcatcagaggaccaaacacttgattgggcagacatttttatgatcctcactcttcctctccatttaaggaagcctcatttattttcaaaactccctctgcctctcagggagacaatcgaatcctactcatcagaaatgaaaaaattatccatggttctctttgagaagatggaaaaagctctacaagtacaagcagttgagattaaggaaatatcagaggtgtttaaagatatgactcaagtaatgaggatgaactattatccaccttgtcctcaaccagagctcgccatcggtcttacgccgcactcagattttggcggtttaacaatcctccttcaactcaacgaagtggaaggattacagataaaaaacgaagggagatggatttcagtcaaacctctacctaatgcgttcgtagtgaatgttggagatgttttggagataatgactaatggaatgtaccgtagcgtcgatcatcgggcagtagtaaactcaacaaaggagaggctctcaatcgcaacatttcatgaccctaatctagagtcggaaataggcccaatatcgagcttgatcactccaaatacacctgctttgttcagaagtggatctacgtatggggaacttgtggaggaatttcattcaaggaagctcgatggaaaatcatttcttgattcgatgaggatgtga

SEQ ID NO: 358 - DNA, 1095 bp, PSODIOX3
atggagaaagcaaaacttatgaagctaggtaatggtatggaaataccaagtgttcaagaattggctaaactcacgcttgccgaaattccatctcgatacgtatgcgccaatgaaaaccttttgttgcctatgggtgcatctgtcataaatgatcatgaaaccattcctgtcatcgatatagaaaatttattatctccagaaccaataatcggaaagttagaattagataggcttcattttgcttgcaaagaatggggtttttttcaggtagtgaaccatggagtcgacgcttcattggtggatagtgtaaaatcagaaattcaaggtttctttaacctttctatggatgagaaaactaaatatgaacaggaagatggagatgtggaaggatttggacaaggctttattgaatcagaggaccaaacacttgattgggcagatatatttatgatgttcactcttccactccatttaaggaagcctcacttattttcaaaactcccagtgcctctcagggagacaatcgaatcctactcatcagaaatgaaaaagttatccatggttctctttaataagatggaaaaagctctacaagtacaagcagccgagattaagggtatgtcagaggtgtttatagatgggacacaagcaatgaggatgaactattatcccccttgtcctcaaccaaatctcgccatcggtcttacgtcgcactcggattttggcggtttgacaatcctccttcaaatcaacgaagtggaaggattacagataaaaagagaggggacatggatttcagtcaaacctctacctaatgcgttcgtagtgaatgttggagatattttggagataatgactaatggaatttaccatagtgtcgatcaccgggcagtagtaaactcaacaaatgagaggctctcaatcgcaacatttcatgaccctagtctagagtcggtaataggcccaatatcaagcttgattactccagagacacctgctttgtttaaaagtggatctacatatggggatcttgtggaggaatgtaaaacaaggaagctcgatggaaaatcatttcttgactccatgaggatttga

SEQ ID NO: 359 - DNA, 1104 bp, Sanguinaria canadensis
atggagaaaacacaaccaatattaggaacttctttgatagtaccgagcgttcaggagttggccaaacaaccccttgtagaggtcccacctcgatatttacgcccagatcaagaccctccaatcatctctcaatctgatgattctctggttccaattacgactgttcctgtcatcgatttgcagtgtttgctatctccagaacccattggagactcggaattggagaagtttcattctgcttgcaaagaatggggtttctttcagttgataaaccatggagtcaactcttcattggtggagaaagtaaaatcggagattcaagatttcttcagacttccaatagaagaaaaaaataagtattggcaggaggaaggagaagttgaaggatttggacaggcttttgttgtatccactgagcaaaaacttgattggggagacatgtttttcatggccactcttcccctccatctaaggaagccacatttatttccaaagctccctctacctctcagggatactttagaatcctactcatcagagttgaaaaaactaaccatggctctcttagttctgatggctagagctctacagattgagactaaggtgacgacagaattgtttgaagatgggatgcaatcaatgaggatgaattattatcctccttgtcctcaaccggagcacgtcattggcctgacaccacattcggattcctcaggtttaacaatcctccttcaactcaatgaaatggaaggactacagataagaaaagaagggagatgggttccagttaaacctctaccaaatgctttcatagtgaacattggagacattttggagattgtgactaatgggatctaccctagcgttgagcatcgggcaacagtgaactcaatgaaggagaggctctcagtcgcgacattccacagccccaacctaaccaaagaaacaggtcctgcacctagcctaattacaccatacagacctgcattgttcagaagagttgggaatgaagagttttggagggaaaggtttcgtcgagaactcaatggaaaatcattccttgatttcatgaagataggaggaggggatggcaacactgcctga

SEQ ID NO: 360 - DNA, 1161 bp, Sanguinaria canadensis
atgaattcatcatcagactcatcagtaccaaagcagcagcagcaggaggaagaggtagtgaagtttggaagaactcttttagtgccttcggttcaagaattggccaaagaacagaacactgagataccacaccgatacatacgtagtggtcttgatgatgaagattgtcccgcaaatatcgtttgtgatcccacttcatcatcatttcccacagtgcctgtcatcgacattcagaccttactttctggagatatatctgcggattccgaattggagacactgcactctgcttgcaaagactggggtttctttcaggtggtaaatcatggagttagctcttcattgatagagaaaataaagttggaaatacatgatttatttgaacttcctttcgaggaaaaaaggaagctgtggcagcaacctgacgacctggagggatttgggcagatgtttgtcgtttcagaggaacagaaacttgattggtcggacatgttttttatcttcacccgtccaactacaataagaaagtctgatttatataccaagctccctctctctcttagagagacgttggaagcttactcattagaactaaaagaactcgccataacaatcttagggcgaatggctgaagctctaaagatggattccacagagatgagagggttattcaacaatggtttccaaacaatgagattgaattactatcctccatgctcccaagcagataaggttttaggtttcaccccacactcagatgcggatgctcttacgatcctcctccaacttaatgaaacagaaggccttcagatacgtaaagatggaaaatggattcctgtgaaaccaatacctaatgcctttgtagtcaatgttggagacataatggagattgtgagcaatggtgtgtatcgtagcatcgagcatcgggcagtagtaaactcaacgaaagaaaggctttccatcgctacattctttagtaccaatcttgatgcagagctaggccctgcacacagcttgattgatcctccacacaaaccagcattgttcaaaagagtgacggtagtgaagtactacgaggacttcttttctcaaaaacttgacaagaaatcgtacatagatttcatgagaattgaaaatgggcaagacaaccattccaattga

SEQ ID NO: 361 - DNA, 1002 bp, Stylophorum diphyllum
ttgtgccctaacaagcaccaccataggaaaaaagaagaaagcactattagaacttcactgagtgagaaagagagcaacgaccaccggagtcacggacattctgtaactaaaatcatggaggcactaccaaagccgccggtcttgggaaattctatgatagtaccaagtgttcaggaattggccagcaaatccttggtaaaagtcccacctcaatatatacaaatgctcgatcatcaagatcccccgttcatcatcaacgaagttttgacagttacaagtgctctacctatcattgatttgcagactttgctatctcatcctgaaaccaataataacaacttcgattcggaattggtcaagctgcactcagcttgcaaaaaatggggattctttcagttggtaaaccatggagtcaacacttcattgctggacaaagtaaaatcagagattgagagtttcttcaaacttccaatggaagaaaagaagaaatattggcaggacgaggaaaattttgaaggatttggacaagcatttgtcttctcggaagaacaaaaactagactgggcagacatgttctacatgatcactcttccccgccaagcaagaaagcaccatttatttccaaagctccctggggctttgagggatgctttggaatcgtacacatcagagctgcaaaatattgccatgaaactcgtagaatttataggcagagcactagagattgagactaaggtaatgaatgagttttttaaagatggattgcagacaatgaggatgaattattatcctccttgtcctcaaccggagctcgtcatgggcctggcatcgcactcagatgccatcggtatatcaattctcttccaacttaatgaaattgaaggactacagataaaaaatgaagggatatggattccggttaaacctttaccaaatactttcgtagtaaaccttggagacattcttgaggtaacagcatattctaacaaatgggctttatcg

SEQ ID NO: 362 - DNA, 1113 bp, Stylophorum diphyllum
atggaggcactaccaaagccgccggtcttgggaaattctatgatagtaccaagtgttcaggaattggccagcaaatccttggtaaaagtcccacctcaatatatacaaatgctcgatcatcaagatcccccgttcatcatcaacgaagttttgacagttacaagtgctctacctatcattgatttgcagactttgctatctcatcctgaaaccaataataacaacttcgattcggaattggtcaagctgcactcagcttgcaaaaaatggggattctttcagttggtaaaccatggagtcaacacttcattgctggacaaagtaaaatcagagattgagagtttcttcaaacttccaatggaagaaaagaagaaatattggcaggacgaggaaaattttgaaggatttggacaagcatttgtcttctcggaagaacaaaaactagactgggcagacatgttctacatgatcactcttccccgccaagcaagaaagcaccatttatttccaaagctccctggggctttgagggatgctttggaatcgtacacatcagagctgcaaaatattgccatgaaactcgtagaatttataggcagagcactagagattgagactaaggtaatgaatgagttttttaaagatggattgcagacaatgaggatgaattattatcctccttgtcctcaaccggagctcgtcatgggcctggcatcgcactcagatgccatcggtatatcaattctcttccaacttaatgaaattgaaggactacagataaaaaatgaagggatatggattccggttaaacctttaccaaatactttcgtagtaaaccttggagacattcttgagattctaacaaatgggctttatcgtagcgttgagcatcgagtaactgttaactcgatgaaagagaggctctcggttgcgacgttctacagccctaaactagaagaagtaataggccctttaccttgcttgattaacccacacaaccctgcattgttcaaaacagttggggttgaggagtatttcaagaaaaggtattctctaaaactcaatggaaaattaaccattgatttcatgaggatagaaggagacactgcttga

SEQ ID NO: 363 - DNA, 903 bp, Tinospora cordifolia
atggacaaggcagaaggacgagcaccagtaacgctgggaaagtcgctactggtaccgagcgttcaagagttggcaagaaaacctctcgccacagttccacaacgatatgtgcgcgaagatcatcaagatgacccatctcttcttaagcatacttgtgctcctacttctcctctgccttcccttcctgtcatcgacttgaaatgtttgcttgacagccaatccgctggttctgagttggagaagttgcactttgcttgcaaggattggggcttctttcagttagttaaccatggagtgagcacttggttggtggaaaaagtaaaatcacaaacgcaagacttcttcaacctgtcgatagaagaaaagcaaaagttttggcaacaaccaggggagatagaaggatttggacaggcatttgttgtttcagaggagcaaaagcttgactgggcagacatgtttttcatgaccacattgcctaaatatttgagaaagccccatttattcccaatgctccctctacatttcagggaaacaatggaagaatactcattagaattaaaaaatcttgcaatgaccatcttggaaatgatggcaaaagctctaaaaatagagacagaggagttgaaattattatttgatgatggactccaagcaatgagaatgaactattatcctccttgtcctcagcccgagcaagtcattggtctcacacctcactctgatgctgttggcctgaccattctccttcaagtcaatgagatggaaggcctccaaataagaaaagatgggatgtgggttcctgtgaacccacttccaaatgctttcgtggtaaacattggagacattttggaggtaacaaccacatacatatacctttacatatataacattataataatttaa

SEQ ID NO: 364 - DNA, 1083 bp, Tinospora cordifolia
atgacaagcaaagcaggtgagcatggttctctccctgtgccaaacgttcaagaacttgcatcaaatgacttgaaaggggttccaagtagatatatcaggccagaacttgagacccatcaagttttaagtgacgagtcactcgaaattccagttatcaatcttcaaaagctcttaaaccaacaacaaatgggtactagtgatgctgacggtgatgatgataatgaaatgtgtaggctacataaagcttgcagagactggggattcttccagttgataaatcatggtgtgccagaggaaataattgagaaaatgaagagtgatacagtggagttcttcaagttgccattagaggagaagaaagcctatgcacaagaaccaggcaacatttttggctatggccaaacttttgtggtgtctgaagaccagaagcttgattggtcagacatacttgttcttcttaccttaccagtctcagacagaatcatgaaattttggcccaccaaaccttcttctttcaggggaacacttgataaatatgcaaaggaaatggagaaactcacaatttgtttgttggatttgattgagaagaatttgggaattgaatcaggaaagctaagaaatgtgtacaagggtgggctacagagggtgaggatgaattattatccaccttgccctgttgcagataaggttctagggttgtctccccactctgatgcttctctcataactttgcttactcaagtgaatgaggttgaagggttacaaatcaagaaaaatgggcactgggtttccattaaagctattcctggagcatttattgttaaccttggggacctacttgagatactgagcaatggtatgtacaagagtattgaacataggggagtcatacaccctgagaaagaacgtttgtcaattgctggatttcaaggggcaaaaagtggagtagttatagggccatttccagagctattgggagagaatggggcaaattacagggctatagagcatgatgcttacttgaagcaatttttttcttctaagcttgatggtaagagggtgctggacctcatgaaattgtga

SEQ ID NO: 365 - DNA, 1050 bp, Tinospora cordifolia
atgaagtccctttctctgccagttccaaacgttcaagaacttgcaagcaagagcgtgaaggatgaagtaccggatcgatatattcggcgtgaactagaatctgaacacgtttcagacgaaagttctgacgaaattcctgtaattgatcttcaaaaactcttctcttctgatgatgaaatgactaagcttcatattgcctgtaaagactggggcttcttccagctaatcaatcatggagtggaagaactaatcaagaagatggtgaaaaatgtagaagagttctttcatcttcctttagaggagaagaaagcttatgctcagcaaccaggggactcccaaggttacgggcaagcctttgtgttgtcggatgatcagaagctcgactggtccgacatgctttctctcactactcttccaatctctgaaagaaacttgcgggtatggcctaagaatccaccttctttcagtgaaacacttgagaaatatgtcactgagatgcaacaacttacatttaaattgctgagtttgattgctaagaacttgggagtggaagagaagaaggtgacaagcgtttttgacgagggattacaaggtgtgagaagcaattactatccaccgtgcccacgagcagataaagttataggcatctctcctcattctgatgcgtctattataactttactcattcaaaataatgaagttccagggctacagatcaggaaatgtgggaactgggtacccgttaaacctatccaaggtgctttcgttgtcaatgttggagatgttcttgagattctgagcaatggattgtacagaagcattgaacacagagccatcatacaccccgaaaaggaaaggatttcaattgctggatttcaagacccaaaccttggaactgttattgggccaattgcagaccttttggatgacaaaaattttgcaaattacaagactatacgttttgatgattattggggccactacttttctgctaaacttgatggaaagagcgtgctgaatctgatgaaactggagaataatcatgcatga

SEQ ID NO: 366 - DNA, 903 bp, Tinospora cordifolia
atgggtactagtgatgctgacggtgatgatgataatgaaatgtgtaggctacataaagcttgcagagactggggatttttccagttgatcaatcatggtgtaccagaggaaataattaagaaaatgaaggatgacacagtggagttcttcaagctgccattagaagagaagcaagcttttgcacaagaaccagagagttttcatggttatggccaagcttttgttgtatctgaagagcaaaagcttgattggtcagatatgcttgttatccttacattaccagtctctgatagagtcatgaaattttggccaaccaatcctcctttcaggggaataattgaaaaatatgcagaggagatggagaaacttacgatctgtttgttgggtttgattgaaacaaatctgggaattgaaggaggaaagctaatcaatacatacaaggatggtggactacagtggatgaggatgaatttttatccaccatgtccagaagcggacaaggttataggaatctctccccactctgatgcttctctcataaccttgcttattcaagtgaatgaggttgaaggattacaaatcaacaaaagtgggaagtgggtccccattaaagctattcctggagcattcattgtcaactttggagatgcaatagaggtactaagtaatggcatgtacaagagtattgagcacagagcagttatacacccagagaaagaacgcttatcaattgctggatttcaggacccaaaacgtggaattgttgttgggccatttccggagctcctggaagatggtgcaaagtataagactgtggaatatgatgaatacttgacacaatatttttccagaaaacttgatggtaagagcgctctmgaccttatcaaattgtcagaaatgtga

SEQ ID NO: 367 - DNA, 1086 bp, Tinospora cordifolia
atggagggcaaggtgacaggcaaaattggtgagtatcgttctctcccagtaccaaatgttcaagaatttgccaaaaacaacttgaaggagattcccagtagatatatcaggccagaacttgagacccatcaagtctccaatattgatgagtcactggaagttccagtgatcaatcttctcaagctcttagatcaacagttactgggcaccaatgatgatgatgatgaaatgggtaggtttcataaagcttgcagagactggggattcttccagttgataaatcatggtgtgccagaggaaataattgagaaaatgaagagtgatacagtggagttcttcaagttgccattagaggagaagaaagcctatgcacaagaaccaggcaacatttttggctatggccaaacttttgtggtgtctgaagaccagaagcttgattggtcagacatacttgttcttcttaccttaccagtctcagacagaatcatgaaattttggcccaccaaaccttcttctttcaggggaacacttgataaatatgcaaaggaaatggagaaactcacaatttgtttgttggatttgattgagaagaatttgggaattgaatcaggaaagctaagaaatgtgtacaagggtgggctacagagggtgaggatgaattattatccaccttgccctgttgcagataaggttctagggttgtctccccactctgatgcttctctcataactttgcttactcaagtgaatgaggttgaagggttacaaatcaagaaaaatgggcactgggtttccattaaagctattcctggagcatttattgttaaccttggggacctacttgagatactgagcaatggtatgtacaagagtattgaacataggggagtcatacaccctgagaaagaacgtttgtcaattgctggatttcaaggggcaaaaagtggagtagttatagggccatttccagagctattgggagagaatggggcaaattacagggctatagagcatgatgcttacttgaagcaatttttttcttctaagcttgatggtaagagggtgctggacctcatgaaattgtga

SEQ ID NO: 368 - DNA, 1098 bp, Thalictrum flavum
atggagggatcaaaacaagtgtcttttgcttctaaactagttcctaatgtccaagaattggccaaacaacccatagattcgataccaccacggtatgtaagaaccgatttagacaatcccaccatcgtctcagttgatcctgcctcaactccaacaattccagttattgatatggaaaaattgcttgatggtgataacatggattcagaaacagataagctgcatacggcgtgcaaggactggggtttctttcagttggtgaaccatggagttgataccacactggttgaaaaagcaaaacatgagattcaagaattcttcggacttccaatagaagaaaagagaaagttttggcagaaagaaaacgaagtagaaggattcgggcaggtccacgttgtgtctgacgagcaaaaacttgattggggtgatatgtttttcatgtatgcattacccataaatgcaagaaagccccacttattcccgaagcttccattaccctttcgagacataattgatgcgtattcacaggagatgaaacttctggccatgaagatcttagggatgatcgagaaagttctaaagatggatgcaaaagagataacacaattgtttgaggatggaagacagtcgatgagaatgaattattatccaccgtgtcctcaaccagagaaggttattgggttaacacctcattcagatgcgggcggtctaacaatactgcttcagataaatgaaatagaaggccttcaagtaagaaaaaacggaatatggatacctatcaaacccctcccgaatgctttcatagtaaacattggagatatattggagatcgggactaatgggatctatcgtagcgtcgagcatcgggcaacagtgaactcaacaaaggagaggctctccattgcgacgttccacaaccctagtcttcaagacgaaatatgtcctttacctaacctcattacctctgacagacctgcaatgttcagaagtattatgactgaggagtataacaccaaactattgactcgagcactcgatggaaaatcattacttgattctttgaggattgaagcgaaatgtgaagatgatggtaattaa

SEQ ID NO: 369 - DNA, 1077 bp, Thalictrum flavum
atggagggatcaaaacaagtgtcttttgcttctaaactagttcctaatgtccaagaattggccaaacaacccatagattcgataccaccacggtatgtaagaaccgatttagacaatcccaccatcgtctcagttgatcctgcctcaactccaacaattccagttattgatatggaaaaattgcttgatggtgataacatggattcagaaacagataagctgcatacggcgtgcaaggactggggtttctttcagttggtgaaccatggagttgataccacactggttgaaaaagcaaaacatgagattcaagaattcttcggacttccaatagaagaaaagagaaagttttggcagaaagaaaacgaagtagaaggattcgggcaggtccacgttgtgtctgacgagcaaaaacttgattggggtgatatgtttttcatgtatgcattacccataaatgcaagaaagccccacttattcccgaagcttccattaccctttcgagacataattgatgcgtattcacaggagatgaaacttctggccatgaagatcttagggatgatcgagaaagttctaaagatggatgcaaaagagataacacaattgtttgaggatggaagacagtcgatgagaatgaattattatccaccgtgtcctcaaccagagaaggttattgggttaacacctcattcagatgcgggcggtctaacaatactgcttcagataaatgaaatagaaggccttcaagtaagaaaaaacggaatatggatacctatcaaacccctcccgaatgctttcatagtaaacattggagacatcttagagattgttaccaatgggatctgtcgcagtattgaacatcgagcaactgtaaacaagctgaaagaaagaatctccgttgctactttctattctcccaaatttgatcgtgaaatgggaccggcacatagcttggttacggagaaaaatccagcattatttagaagaattgtagtggaagactacatgaaaggatttttcgcacgcaagcttgttggaaaatctaatcttgatgtcatgaggattgataattag

SEQ ID NO: 370 - DNA, 1086 bp, Thalictrum flavum
atgagtactactgtcatgcaagctgaatggcctgaaccaattgtcagagttcaatctttggcagaaagtggtttatcggttattcctgaaaggtatgtcaaaccaccatctcagaggcctaagttggatttagtagttgatcatgaaatcaatatccctattattgatttgtctggccttgagggggatgatgatcaacttagaaagactattttgaatcaaatttcggtggcatgtcgagattggggtttttttcaagttgttaatcatggtgtaaagcctaaattgatgcatgaagcgcgggaagcttggagagacttttttcatttaccagttgaggagaaacaaatttatgcaaattctccaaagacatatgaagggtatggtagtaggctaggggtcgagaaggacgctattcttgattggtgtgactacttttttctacactaccgacctcagttactcaaagaccataacaaatggcctgctttccctgtttcattgaggaacctaatcgaggaatataattctgaattggtgaaactatctgggagattaatgaagattttatccgtgaaccttggattagacgaagaatatcttcaaaatgcatttggaggggaaaacataggggtatgcatgagggtgaatttctatccaaaatgtccacaacctgatcttgctcttggcctctcatcacattctgaccctggtggcatgacccttcttcttcctgaccattctgtttctggtctccaagtcagaaaaggtgataaatgggtcaccatacaacctgctccagatgccttcatcattaacattggtgatcaaattcaggtgctgagcaatgcaatatacaagagcattgaacatagggctattgtcaattcagttaaggagaggatctcgatcgcctttttttataaccctaaaagcgatttactcttggaaccagcctctgagctcgtgacacaagatcaacctgctctatacctaccaatgacgttcgatcaatacaggcttgagattcgaacaaggggtcctcgaggaaaagcatatatggaatcattaaaatctccgcgttaa

SEQ ID NO: 371 - DNA, 1086 bp, Xanthoriza simplicissima
atgacaaaaaatcttaataatttgggaggttcgttacccatcgacaacgtccaatctcttgctggtacagagttgaaagacgttcctgaacgataccttagaccagaattggagtatgacaatgatgtagtttctactgataaggaggatgtggaaatcccagttatcgatctgtcaagactcctcaatcaaaagtttgcttctgatgaactggcaaagttccactcagcctgcctagactggggcttcttccagttgatcaaccatggagtatcagaggaagtgattgagaaaatgaaggttgacatggaagacttctttcggcttcctttagaagagaaaaatgtttatggccagctacctaatagtaccgaaggttatggtcagtcctttgttaaatctgacgagcaaaagcttgagtgggcagacatgcatttgttaataacaaaacctgttcaagaaagaaacatgaggttttggcctaatactcctacttctttcagggcaacagtggataaattctcaacggacgttcagaaagttgcaatgtgtctcataggaatgatggcgaaaaacttggggcttgaatcacaagtattgacgaagcctttcgagaactgtattcagtgtgtgaggatgaactactacccaccttgtcctaacttcgacaaggttttgggactcactccacattctgatgctagtagcctaactctcctccttcaagttaatcaagtaaatggactgcagataaagaaacatggaaagtggtttcccattaaacccattttaggggctttcgttgtcaacattggtgacatattagagataatgaccaatgggatatacaagagcattgagcacagggttgttattaaccctgacaaagagcgtctctcgatagctattttccatgacccagaatttgcagctataattgggccggtccaggatcttgttagaaaatatggtgccagatacaagtccataagtcatgcggattacttgaaccaatcaattaataacaagctcgatagtaagacctttcttggtaagttcaaactaatcaacaatgaaagagagtaa

SEQ ID NO: 372 - DNA, 1089 bp, Xanthoriza simplicissima
atggaagcaagagaggtagtgagttttggaagttcactgattgtgccttcagttcaggagctggctaaagagcagatagatttgatctcacctaggtacatacgttctgatcaacaggaccatccaattttccttgatcccagtttgctttccactgtcccggtcatagacatgaagatattgctggctcatgattcagcagaatctatacactctgaattggaaaagttgcactatgcttgcaaacactggggtttctttcaggtagtcaaccatggaattgattctatattgattgagaaaatgaagtccgaaattcaagacttcttcaaacttccatatgatgagaaaaagaaactttggcagcaaccagggaatcatgagggatttggacaactttttgttgtatcagaagagcaacaactggattggtcagacatgttctatattaccactcttccaaacagtctaaaacagcctagtctgtttgcaaagatccctctcccactgagagagaccttggaagcttactctctagaactgaaaactcttgccagaactatcttgggaaaaatggctgaagcgctagagatggataccgaggagatgaaagagttgttcagtgatggggtacaatcaattagattcaattactatcctttatgtgctcaaccagaacaggtcctaggctttactcctcactctgatgccgatgctctgacaattctccttgaagttaatgagacagaaggactacagatcaggaaagacggaaaatggattccggtgaaacaagtgccaaatgctcttgtagtcaatgtcggagacatcatggagatagtgagcaatggtgtgtatcgcagcattgagcacagggcaatagtaaactcagtgaaagagaggctctcagttgcaacgttctatagcactaatgtagatgctgagatacgccctgcaccaagcctgatcaccgcaaaaaatccggcatcgtttagaacagttccagtggagaaatacttcaaggaattatacgcgagaaaacttgatggcaagtcttacctagatttcatgagaatagaaaattgttga

SEQ ID NO: 373 - DNA, 1899 bp, Argemone mexicana
tgtttgacccaaaacaatatcacaaaatgaagaagatgattccaaattcatcatcttcatcaattctttcagtccttgttttactattattctcaacaagttcatgggcagctaattcaattcatgaagattttctaaattgtctttcaatctataaatcttcatttccaatccctatttacacatccaagaactcttcatttaataccctctttagatcctcagctcgaaaccttcgatttttatcacccaattcaacacaaaaacctgaatttataattactccaacacttgaatctcatgttcaaaccactgttgtttgttctaagaaacacgggttagatctcaaagttcgaagtggtggtcacgatgtcgaaggcttgtcatacgtctctgattctccttatgtcatgatagacttagtcgattttcgaaacatcactgttaatgtaaagaatgctactgcttggattcaagctggttcttctcttggagaagtttattataaagttggtaatgaaagtaagaatacccttggatttccagccgggttttgcccgaccgtaggcgttggtggtcacattagcggaggtgggtttggttccttggttaggaaatatggacttgcatctgatcaagtcattgatgctagaattgttacggttaatggtgaaatacttaacaaaaaaaccatgggaaaagatttatattgggccattcgaggtggaggagctaacaatttcggtgtgcttctttcgtggaaagtcaagttggttcctgttacgcctatcgtgaccgttgctacaatagatagaaccttagaacaaggtgcgactaacctagttcataagtggcaattcgttgccgataggcttcatgaagatgtttacattggtctcacaatggtcactgctaatactagtcgagccggagaaaaaactgtagtagctcaattctcgttcttgtttctaggaaacactgatagacttctccaaatcatggaagagagtttcccagaattaggtttaaaacgtaatgacacgacggaaatgagttgggttgaatctcacgtgtacttttatcgacgaggacaacctatagaatttttatgggatagagatcatctaacgaagagttttttgaaagtgaaatcggattacgtaagagaaccgatatcaaaattagggttagaagggatatggaaaagatatgtaggaggagattcaccagcaatgttatggactccatttggtggaagaatgaatcagatttctgaatttgaaagtccttatccacatagagctggaaatatttacaatattatgtatgttggaaactggttaaatgaaaatgagtctgaaaaacagctgaattggatgagaagtttttatagttatatgggtcgatatgtatcgaaaaatccgagatcggcgtatttaaattacaaggatcttgatttaggggttaatgataataatgttagtgaatacataaggtatttaaaagctagatcatggggtagaaaatatttcaagaataattttgaaaaattagttaaagtaaaaagtatggttgatcctgataatttcttcaagaacagacagagtattcctcctattaggtcttggggtaaagaattagaagccattaatattgtaatttaagtttgatttttttttttatcatctttgtgggttagttgtttagtatgtgctacttgttttttgtttacatgtaataatggggaggagagaggacctcgtaattgcttttgttggggttggtttcatgcctaaccttctttactgtagttcttctcttactaattcagtactacttgtaccagtgttttgtaccagtaattttaccgattttctacaatatatttgagtagtagct

SEQ ID NO: 374 - DNA, 1803 bp, Chelidonium majus
tttcacaacttccatagagattaaccaacatagaaactagagatgatgaggatttcaagctctgtaactctttcatttctttccttctttgtattattattctcaaccagctctttggcagctacttcaaattcagatcatggtgactttcttcaatgccttgctctacataagccttccactccaattcccatatatacaccaagcaattcaaactttacaactctgttccgatcctctgctcgaaacctgagatttttatcacccaactctactcaacctcaattcattattacacctacacatgaatcccacgttcaggccgctgttgtttgctgtaggaaacatgggttagacctcaaagttcgaagtggaggccatgacgttgaaggactatcttattggtccgatgctccattcgttattgtcgacttggtaaattttagaaacataacagttgatgtaaaagctaagactgcatgggttcaggcaggtgcatccctcggggaggtttattacaaagctgcaaatgcaagcaacacccttggcttcccggccgggttttgccccactgtaggtgttggtggacacattagcggaggtgggatcggtgccttggtgcggaaatatggtctagcatctgatcaagtcattgatgctcgcattgttaccgttgatggaaaaattctagacaaaaaaaccatgggaaaagacctattttgggccattagaggaggaggtgcttccaacttcggagttattctctcatggaaagtcaaggttgttgatgttacacctattgttactgttggtacagtgagtagaacattagaacaaggtgccacagaccttgtttataggtggcaattcattgctgataggctccatgaagacctctacctcgcttccacaatgactgtcgctaatggtagtcgagcagggggaaaaacggtcctagtcaatttcttcttcgtgttccttggggatactgacagacttctacgactcatggaagagagcttcccagaattgggtttaaaccgtagtgattgcaatgaaatgagttgggtagaatctcacgtgttcctctatgcacctggaagaccagtagaatatttatgggatagagatcatgaaaccaagagttttctgaaaataaaaacagactatgtaagggaaccaatctccaaagctgcattagaaggcatttggataaggtttatgggaggacaatcaccagcaatgctttggactcctatgggcgcaaggatgaacgagatttcagaatctgaacttccttacccacatagagctggaaacatttacaacatcatgtatgttggaaactggcaacaagaaagtgaatctgaagtaatgttagactggatgagaaggttttacaggcacatgggtcgctatgtatcgaagaatccaagatctgggtatctcaattacaaggatcttgacttgggtcagagcgagagcggtgatagtgaggcgatgagctacataagagctaggtcatggggtaggaaatacttcaagggtaactttgaaagattggtgaaagtgaagagcatggttgatcctggtaatttcttcaagaacaaacagagcattccaccaataaagtcttggggaaagaattaattaaagggaggagactaataatcatttgtttcagggacacaatattatttctagtgttttatttgaataaactcacatgttactatatttagttggggttgtaagattttctaaaatttgatctctctgtagatttaagttactatttaataa

SEQ ID NO: 375 - DNA, 2054 bp, Corydalis chelanthifolia
gatgatttctttttcttctacttctagataaattcacaagtcctcctttgaattcttcttttcttcttccagtttttcaaagtattgaaatttgttctagctagctagctagtagtggcttgggtttgtgtataaatagaacttctgagtgctcataacttcattccattgcaacaacaaaacttgaaagagatggggatttcaagaatcagagtagtagtagtagtctcatctttgctttccattcttgtgttgtccaatatttctttggcaacttcagcagcttcagttaatgaaaactttcttgaatgcctttccctacaaaagactcctatcccaatcccaacctactcaccaaacaacttctcttattcaaccattttcaattcctcagctagaaacctcaggttcttatcaccaacctcagaaaaacctcgatttgtcatcacacctttgcatgaatcccatgttcaagcagctgttgtttgttgtaagaaacaccacttagaacttaaagttcgaagcggaggacatgatcttgaagggttatcttatacgtccgagactccatttgttatcgccgacttggtgaactatcggaatatcagtataaatgtggaagataagagcgcatggattcaggctggtgctcaattgggagaagtttattatagaattgccgagaagagtaagactcttggtttccctgctggcttttgtcccactgttggtgttggtggacacattagtggaggtggattcggtggcttggtgcgaaagtatggtcttgcaagtgatcaagtcatcgatgctcgcatggttgatgctaatggaaatattcttgacaaagaatcaatgggcgaagatctattttgggccataagaggagggggagcgtctaacttcggagttatactctcatggaaagttaagctggttccagtcacacctaatgtaaccgttgcaatagtcgacaaaactttggaacaaggtgccacaagcctagtatataagtggcaacagattgccgataagctccatgaggacctatacatctcacccacgatgtctactgttaacgctagccgaggcggtcagagaacagtgctggttcaattttccatcctattcctcggaggtattgatagactcctccaactcacccaacagagctttcctgaattgggtttgcaacgtaaagactgtactgaaatgagttgggttgaatctcacgtctacttctatgcacgaggaagaccattggaacttttattggacagggatcatgtaaccaagagcttcctcaaggtgaaaaccgattacgtcaaggaaccaatatcgataacaggtttggaagggatatggaggaagtttttggaaggagatgcacctgtaatgctttggactccattcggtgcaaggatgaatgagatttccgagtctgaatctccttaccctcatagagcaggaaacatgttcaatatcatgtacatagcaaattggcaagacgaccgggaatcacaaaaacacatagactggataagaaggttctatagttatatgggttcatatgtttccaagttcccaagggctgcatatctcaactataaggatctcgatttgggtgagcatagatatggtcccttaattaactcattgactgcgcggaattggggcaacaaatacttcaagagcaacttcgaaagattagtatatgtgaagagcaaggttgatcctagcaatttcttcaagaacaaacagagcattccaactttttgatttatatgagatatcagaattaggcttggatacaactgccatttaaccatctagagctagcctaaatgaccattggtttatactttcactggggagaccgagatttgattctcgactctgcaataattattagaataattatcacccgtatgtgggtgtgcctggtcaccttagtggggtgtatgtattatcattgccatttacttttaattaattttttatatgtacttgtattgtaataaatttggattatataataataataggagtattga

SEQ ID NO: 376 - DNA, 1814 bp, Eschscholzia californica
ttcttctcttccttttctttctcttcatcaacttcctctacctttccttcattacaaatttcatcaaaacaagatgaaaatggggatttcttcatcaccttcttcttcttcaactctttcactactttctcttcttcttgttttcttcatctcattaactagttcttgggctacccattcaaactcacttcatggagattttatccaatgtgttctttctcaacacctttactcttccattaaagtccctatttacacaccccagagttctaactttacttctctttttagatcttctgctagaaacctcagattcttatcaccaaatttgactaaacctcagtttataattacacctacccatgaatctcatattcaagcagctataatttgttgtaagaaacatgggctagacctaaaagttagaagtggagggcatgatgttgaaggtctttcttatgtgtccgatactccatttgtcattgttgatttggttgatttccgaaatataactgtcgatgtcaagagtaagacggcttgggtacaagccggtgcttcgcttggagaagtttattatgcagtagctaataagagtaaaacccttgggtttccggccgggttttgccctactgttggcgttggtggacatattagtggcggtgggtttggtgcgttggttcgtaaatatggtcttgcatctgatcaagttatagatgctcgctttataaatgcggagggaaaaattcttgacaaaagaaccatgggagatgacctattttgggccattagaggtggtggtgcagctaactttggaattattgtttcatggaaagtcaagttagttgatgtaacacctattgttacagttgctactgtcaatagacctttagaacaaggtgccacaaaccttgttcacagatggcaatttattgcagataggctccatgaggatgtttatattggacttacattgattgttgccaatggtagtcgagctggagggaagaccgtaatagctcaattctcgttcatgtttctggggcgaaccgaccgtcttcttagtctgatggaagagagctttcccgagttggatttgaagcgaaccgactgcaacgaaatgagttgggttcagtctcatgtttacttctatgcaccaaatagaacaattgagtttttatgggatagagatcatgtaacaaagagttacttaaaaataaaagcagattatgtaagagaaccaatttcgaaagcagggttggaaggtatttggaaaattttcatgacaggagattcacctgcaatgttatggactccgatgggtgcaagaatgaacgagatttcggagtttgaaactccttacccacatagagctgggaacatatataacatcatgtatgttgggaactcggcgcaagcaaccgaatcagaaaaccaagtaaactggatgagaagattttatcagtatatgactccatatgtttcgaagaacccaagatcggcgtacctcaactacaaggatcttgagcttggccagaacagaaagaatgatagtgaggcaatggcctacattagagcaaggaattggggaaggaagtattttaaaggcaattttgagagattagtgaaagtgaagagtatggttgatcctagtaatttcttcaagaacaaacagagcattcctcctcttcattcttggggaaaacattaagtactagacatcattccgtatcgacgtaattcttctttattgatttgaaattcttggttgtttattttctatttactttatgagattgtaattaagatttgtgaag

SEQ ID NO: 377 - DNA, 1673 bp, Glaucium flavum
tccctacctagaaattaaacaacaggttgaaactaaaaatggggatttcaagctttgcaactctatcatttctttctttccttgtattattctcaatcggctcttcggcagccaattcaaattcagttcatggagacttcctccagtgcctttcttctcttaatcaaacttcgacaccgatcaccatctatacaccaagcaattctaactttacggaactgtttcgatcctctgctcgaaacctcagatttttatcacccaactcaacacaacctcaattcataattacacctacccatgaataccacgttcaagccgctgttctttgttctagaaaacacggtttagatctcaaggttcgaagtgggggacatgacgtcgaaggactgtcatattggtccgatgttccattcattattgtcgacttggtgaattatagaaacatcacagtggatgtaaaagctaagactgcgtgggttcaggctggtgcttccctcggggaagtttattaccaagtcgcaaatgcaagcaagaccctcggattcccggcagggttttgcccaactgtaggtgttggtggacatattagtggaggtgggttcggtgcgttggtgcgcaaatatggtcttgcatctgatcaagtcattgatgctcgtattgttaccgtcgatggcagaattcttgacaaaagaaatatgggaaaagatctattttgggccattagaggaggtggtgcttccaactttggagtcattctctcctggaaagtcaagttggttgaagttacacctattgtgactgtagctacagttggcagaacattggaacaaggtgccactgaccttgttcataagtggcaattcattgctgataggctccatgaagacatctacattggactgacgatgactgtagctaatggtagccgagcaggggaaaagacggtgctagcccaattctccttcatgtttcttgggggaactgacagactcctccgactcatgcatgagagcttccctgaattgggattgaatcgcagtgactgcagcgaaatgagttgggtggaatctcatgtctacttctatgcaccaggaagaccagtagaatatttatgggatagagatcatgttactaagagcttcctgaaaataaaagctgactatgtgagggaaccaatttctaaatctgggttggaagggatatggagaaggtttatgggaggtcaatcacccgcaatgctgtggactcctatgggtgcaaggatgaacgagatttcagagtttgagcttccttaccctcacagagctggaaacatttacaatattatgtacgttggaaactgggtagaagaaaatgaatcagaaaagcagatagattggatgagaaggttttacaattacatgggtcggtacgtttcgaagaacccaagatctgcatatctcaattacaaggatcttgatttgggtcaaaacgagaacagtgatagtgaggcgatgaggtacataaaagccaggacatggggtaggaaatacttcaagggtaactttgagagattagtgaaagttaagagcatggttgatcctggtaatttcttcaagaacaaacagagcatcccaccaattaagtcttggggaatagaggcaggagactagatgattaatttgcatttaaaa

SEQ ID NO: 378 - DNA, 1802 bp, SACFADX1
gggaaacctgaaaccatatcttccatcacttccatcgaaattagcaatacagaaaattaactaaagatggggatttcaagctctgcaacgctttcatttatttcattccttgtgttattattctcaagtactgcttctttggcagccaattcaacttcagttcatggagactttctccaatgtctctctatccataattcttccgttccaatccccatctatacaccaaacaactctaactttacaaccctgtttcgatcctctgcacgaaaccttagattcttatcgcccaactcaacacaacctcaattcataataacacctacccgtgaatcccacgttcaagcagctgttgtttgctgtagaacacacggcttagaccttaaagttcgaagtgggggccatgacgtcgaaggacaatcttattggtccgatgttccattcgttattgttgacttggtcgattataaaaacatcacagtcgatgtagaatctaagactgcctgggttcaggctggtgcttccctcggccaagtttattatgaagttgcaaataagagcaagacccttggcttcccagccggattttgcccaacagtaggcgttggtggacacattagcggaggtgggttcggtgccttggtacggaaatatggtctcgcatctgatcaagttattgacgctcgcattgttaccgttgatggaaaaattcttgacaaagaaaccatgggaaaagatctattttgggccattagaggagggggtgcttcaagctttggagttattctctcatggaaagtcaagttggttgacgttacacccatcgtcactgttgctacagtcggcagaaccatagaacaaggtgccacagaccttgttcataggtggcaattcattgccgataggctccatgaggatgtctacatcggcctcacaatgaccgtcgctaatggtagcagagcaggggaaaaaacagtgctagcccaattctccttcatgttccttgggggaactgacagactcctcggactcatgggagagagcttccctgaattgggtttgaaccgcagcgactgcaaagaaatgagttgggttgaatctcacatctacttctatgcacctggaagaccaatagaacttttatgggatagggatcatctaaccaagagcttcctgaaaataaaagctgactacgtaagagaaccaatctcaaaagatggattggaaaggatatggataaggtttatgggaggacaatcacccgcgatgctatggactccaatgggtgcaaggatgaatgagatttcagagtctgaacttccttacccacatagagctggaaacatatacaacattatgtacgtcggaaactggctacaagaaagtgaatcagaacaacagatagactggatgagaaggttttacaactccatgggtcggtatgtttcaaagaacccaagatccgcatatctcaactacaaggatcttgatttgggtcagaacgagaatggcgctagtgaggcgatgagatacataaaagctaggacgtggggtaggaaatacttcaagagtaactttgagagattagtgaaagtgaagagcatggttgatcctgataattttttcaagaacaaacagagcattccacctattaagtcttggggaaagaattagaggaggacatgacttattattatttggtttcgttattaatacagaataattacagatctttagatttaatttgaataaattcgtttgtcatttatatttactttgaggttgtaagattcgttggaggt

SEQ ID NO: 379 - DNA, 2320 bp, Stylophorum diphyllum
tgttcggataacttccaccgagattaaccaacatagaaaactaaagatgatggggatttctagctctgcaactctttcatttgtttctttccttgtattaatattctcaaccagctctttggcagccaattcctcagttcatgatgactttcttcaatgcctttctcttcataagccttccactccaactcccatctatacaccaagcaattctaactttacaaccctgttccgatcctctgctcggaacctgagatttttatcacccaactcaactcaacctcaattcattattacacctacacatgaatcccatgttcaggccgctgttgtatgttgtaggaaacatgggttagacctcaaagttcgtagtgggggtcatgatgttgaaggactgtcttattggtccgatgctcctttcgttattgtcgacttggtcaattataggaacatcactgttgatgtaaaagcgaagactgcatgggttcaggctggtgcgtccctcggcgaagtttattacaaagttgctaatgcgagcaatacccttggattcccagccggtttttgccccactgtaggtgttggtggacacattagcggaggtgggatcggtgccttggtgcggaagtatggtctttcatctgatcaagtcattgatgctcgtattgttaccgttgatggaaaaattctagacaaaaaaaccatgggaaaagacctattttgggccattagaggagggggtgcttccaactttggagttattctctcatggaaagtcaaggttgttgatgttacacctatcgttactgttggtacagtgagtagaacattagaacaaggtgccacagaccttgtttataggtggcaattcattgctgataggctccatgaagacctctacctcgcttccacaataactgtcactaatggtagccgagcagggggaaaaacagtcctagtcaatttcttcttcatgttccttggggatactgacagacttctacgactcatggaagagagcttcccagaattgggtttaaaccgcagtgattgcaacgaaatgagttgggttgaatctcacgtctacttctatgcacccggaagaccagtagaatttttatgggataaagatcatgaaacaaagagcttcctgaaaatcaaaactgactatgttagggaaccaatctccaaagctgcgttggaaggcatttgggaaaggtttatgggaggacaatcaccagcaatgctgtggactccaatgggcgcaaggatgaacgagatttcagaatctgaacttccttacccacacagagctggaaacatttacaacattatgtatgttggaaactggcaacaagaaagtgaatctgaacaacagatagactggatgagaaggttttacaggcacatgggtcgctatgtttcgaagaacccaagatctgggtatctcaattacaaggatcttgacttgggtcagagcgagagcggtgatagtgaggcgatgagctacataagagctaggtcatggggtaagaaatacttcaagggtaactttgaaagattagtgaaagtgaagagcatggttgatcctagtaatttcttcaagaacaaacagagcattccaccaatcaagtcttggggaaagaattaaagggaggagactaattaatttatttggttaacacagtataattatagttctttttattgttactaattaaatttgtatgtcatttatatttacttatgtttgacttgtacgtgttgtgaacatataaataaaattcaggggcaacgtagtggggacttccacaagttgtatgcagcaacccatcatccctaaaatgttgaggtaaagcacttaggccaaaatcagatatctttatattccctttcgcatcaagaagaacgttctccggcttaagatccctatggcagacacctttgtcgtgacagtagctcagagcatcgattaactgttggaagatctttcgtccttcagtttcagatagcctccctttaaagtcaattctctcaaatagttctccaccaatcacaagttcaagaaccatgtaaatcttggttttgctggccaagacctcatgtaacctaacgacgtttggatgcctcaaaagcttcaaagttccaatttctctctttatttgattgctgatattgaggtcaaggatggtcttttttttccagtatcttaactgcaaattcatgaccagattcaatattctttgcgtatttaacttttccgaaattaccctcaccgagagtccttccaagttcgtatttaccccgtcgcattcccttc

SEQ ID NO: 380 - DNA, 844 bp, Thalictrum flavum
tgtatatgaagatttctaaatttcaactactttcaattataatgttcatgactacttgtagtatttcactgttagatttagcttcttcttcaagttcaaattatgaaagttttctccaatgttttgatacctactccaattcttccattccaattcatagtccatcctcttcttcctatacatcaatcttgcatgcttcaatctacaacctgaagttcatatcaccaaccatcccaaaacccaaatttatcatcacacccacgcatgaatctcatgttcaagtaactgttgtttgttgtagacaacatggtttgcaaatcagaactagaagtggtggtcatgacttcgagggcctatcttatgtatcctatgtcccgtttgttcttcttgacctaatccatcttcgaaagattagtgttaatatagaacataacactgcatgggttcaaactggtgctactattggagaactctactatagaatcgcagagaagagtaggacgcatgcctttccagctgggttgtgtcccagtgtaggtgttggtggccacatcagtggagctggatatggtattttgatgagaaaatatggtctctcagctgatcatgtagttgacgcacgactagttgatgtcaatggtagaattcttgataaagaatccatgggggaagatctgttttgggctattagaggaggaggagcatcgagctttggagttgttctttcatggaaaatcaagttggttccagttccacaaacagtcaccttttttttcaccgcggagaactttagaccaaggagcaacaaaacttgttcaaaaatggcaacaaatttctagtcagc

SEQ ID NO: 381 - DNA, 1180 bp, Thalictrum flavum
ctgtcagctgatcatgtgttgatgcacgattagttgacgtcaatggtagacttcttgataagaatccatgggggaagatctgtttgggctatcagaggaggaggaggagccagctttggagtgattctagcatggaaaattgggctggttccagttccacctactgtgactactttcatagtccctagaactttagaacaaggtggcagtgctcttgttcataagtggcaattcattggtgataagctcactgaagatttattccttggcctcagtatacaagctatgcaccttgatggtgaccataatggtaagaaaaccattttaatttcatttctaggacattaccttgggcctatggaaaaattactacagctaatggaagagaacttccctgaaatgcaactgaaaaaagaagactgcattgagatgagttggatcaaatcagcagtctactttggtgtgtttactcttgaaagtaatctgaatattttactagagagaaagaatcctttcccgccaaaaggcaggtacttaacaaaatctgactatgtacaagagcctatgtcagagaatgctttggaagggatatggaaaagatttcacgaaattgatgaacctgaaatcatcatgagtccttatggtggaagaatgaatgagattgaagagtctgcaattgcatttccacatagaaaaggaaacatgtataagatcaactacattgccctttggaaagaagaaggagatgaggcagaaagaaaacatgcaagttggatcagagaattgtacagctacatgactccttatgtttcaaaatccccaaggtgtgcatatcttaacttcaaggacattgatttgggtcacaaaaggaatggtactgcaacctacctggaagctaaagtttggggaaacaagtatttcaagaacaactttgataagttggtaaatgtaaagactagaattgatcctgatgatttcttcaccaatgatcaaggcattccacctcttccatctctggcagaagacaaatagcaagacttgtaattccacaattccaattttattaagatgacttgtgaaatttctacaacacatctttatctttattatttactaaaacatgtttaactttactgcaaaaaaaacatttagttgacatttgacaaataagaaattcagc

SEQ ID NO: 382 - DNA, 1929 bp, Hydrastis canadensis
aagcactacacttcacataagaaaaaaacatccacaagtctcaaagaagcaaaactttgaggagatggaaacttcaagttttttaatgatctctttccttgtgttcacaactttttgtgtaccctctgcaagtatacatcatgaaaattttctccaatgccttgaccttcattctaattcttccataccaatttacactccaaatagtccttcttatttatcaatcttgcatgcttcaatatataaccttaaattcaagtcaccatcaaccccaaaaccaaatttcattatcacacccatgcaagaatctcatgttcaagcagctgttgtttgttgtaaaaaatataatttacaacttagaactagaagtggtggacatgactttgaaggcctatcttatgtatcttatgtcccatttgttctccttgatttgattcatcttcgatcgataaacgtcaatatagaagataatagtgcatgggttcaaactggtgcaactcttggtgaactttattatagaattgctgaaaaaagtagaactcatacatttccagcagggttatgtccaactgttggtgtcggtggacatattagtggtgctggttatggtgctttgttaagaaaatatggtctctcagctgatcatgtcatcgatgcacgtttagttgatgttaatggtagaattcttgataaagaatcaatggaagaagatcttttttgggctattagaggagggggaggagcaagttttggagtaattcttgcatggaaattaagattgcttcctgttccacctactgtcacaattttcatactccccaaaactttagaacaaggtgcaacttcccttgttcataagtggcaattcgttgcagataatctccatgaagatctcttccttggtctaagtatacaaaccatgaacatcgatgatgaccgtcgtaaaggtgaaaaaacaatactagtttcatttttttgcctttaccttggaggtgttgaaaatttagtccaaatgatgaaacaaagcttccctgaattggggttaaagaaagatgactgtcttgaaatgagttggatcagatcagcagtctatttcggcgtgtactcgaatgaaagatctttaagtgttttattggaaaggaagaaccctgtccctcctaaaatgcactacatggtaaaatctgactatgtaaaagaacccttttcagaaaatgtgttggaaggtatatggaaatttttttatgaggtcgatatgcctgaaatcatcatgagtccttatggtggaaaaatgagtgagatttcagagacagcaattgctttcccacatagaaaagggaacttgtataagatcaattatttagtgtcgtggaatgaagaaggggatgaagtatctgaaaaaaatgcaaattggataagagaattgtataagtacatgaccccttatgtttcgaagaacccaagagcttcatatcttaatttcaaggatattgaattgggtcataaaaaaaatggttctgcaacttacttagaagctaaagtttggggtagtaaatattttatgaaaaactttgatagattagtatctgtgaagaccaaagttgatcctgatgattttttcaccaatgagcaaggcatcccacctctttcatcttaagagaagataagagctcacttggaatttcaccatgcatgtcacatttcaatggaaattctctctcattttcgttttcatttttatgtgaaaacaataatcctattaatttactctgttgatcgaattattctgtccattttatttttaataattaagtgtgagatcagcatgtatgtgatttttatttgtatcttctttatttcatggtgtacccatcaaggacctttatcgctcctggggtgaaactgtccattgtacaataagattatgccata

SEQ ID NO: 383 - DNA, 2017 bp, Xanthoriza simplicissima
atgttttcattaatcaagaacgagtgtatcagagaggaactaacacagttaagctccaatagaaacatattgagtttgaaaaagatgggcatttcaagttttgtagtattatttccttttcttgtgttcatagctttagcttcttcttcaagttcacaagatgaaggttttctgcaatgccttgatcttcattccaattcttcaataccagtttacaacccaagctcttcttcctatacatcaatcttgcatgcttccatatacaaccttaaatttatatcaccagccactccaaaaccatatttcattatcacacctatgcgtgagtctcatgttcaagcaactgttgtttgttgtagggaacatggtttgcagattagaactagaagtgggggtcatgactttgaaggcttatcctttgtagcacatgttccttttgtacttcttgatctaatccatcttcgaactatcagtgtcgatatagaagatgaaactgcttgggtgcaaacaggtgctactcttggtgagctttattataggattgctgagaaaagcaggactcacgcattcccagctggattgtgtccgagtgttggtgttggtgggcatatcagtggagctggatatggtattttgctgagaaaacatggtctctcggctgatcatgtcatcgacgcacgtttagtcgatgtaaatggtagaattcttgataaagaatccatgggggaagattatttttgggctattagaggaggaggaggagcaagctttggagtaattcttgcgtggaaaataagattggttcctgttccacctactgtgactacttttatagtccctagagttttagaacaaggagcaactgcactagttcataagtggcaattcattgctgataagcttgatgatgatctcttcctgggcctcagtgtacaagccatgcaccttgaccctgatcatccggagaaaaagacagtagtaatctcatttctaggcttttacctgggagctgctgaaaaagtactccagttaattgacgaaagcttccctgaactggggttaatgaaagcagattgtattgagatgagttggatcagatcggcagtctactttggtatctttcaacttgaaaataatctgagtcttttattagaaagaagaaatccaatcccaccgaaaaaccgatacatgacgaaatctgactatgtacaagaaccagtatcagaggatgtgttggaagggatatggaaaaggttttatgaagtagatgaacctgagatcattatgagtccttatggtggaaagatgaatgagattgaagaatcagccattgcttttccacacagaaaaggaaacatgtacaagatcaactacttggtgtcatggaaagaactaggggaagaggcagagaaaaagcatgcaagttggatcagagaactttacaattacatgactccttatgtttccaagtccccaaggtgttcatatctcaacttcaaggatattgacttgggtcacaaaaagaatggtactgctacttacttagaagctaaagtttggggtagtaagtatttcaagaataattttgatagattggtatctgtgaagacaaaagttgatcctgatgacttcttcacaaatgaacaaagcattccacctcttccatctttggcagaaccaaagaagtgaatttggaactgtagcaagcttttcacatttcactgaaaatttccttttccttttttattttcgttttttttttaatgtggaaagtggaaactgcggttgattctgttaattttggtagtccataaatccagtattgatcctaatatggaatgcctccactgtatgccagtttccaatcccatcacactttggtcatctatcattattaccattgtttatgaagcagttggtcaaattgcttgttctttagtatatgggcttcagatttacttattttgttttttcatgagctacgaatacgatgtatacatatattatatatatatgg

SEQ ID NO: 384 - DNA, 1617 bp, Nigella sativa
gcaacttcatccatggttgcagtcctcgctttgcttttaaccttttcattagcaacttcagcctcagtgcatgaaagcttcctccaatgtcttggttctgaaccttcaacgccattatacacaccaaacacttcttcttatacttcagtcttgcaattctcagtaagaaactttaggttttcgacatcttcaaccccgaagcctgatttaatcgtaacacctttagatgagtctcaagttcaagccgttgtagtatgttctcgaaaacatggattgatgatgaaaattcgaagcggaggacatgattatgaaggcctttcatatgtgtctgatgttccttttatcatccttgatcttattaatcttgattcaataagtgttgacgcaaataaaggaactgcatgggtccagtctggtgcatccattggccaactctactacagaattgctgagaagagtaggacgtatggatttcctgctggagtttgcactactatgggtgttggtgggcatttcagtggtggtggttatggttctttgatgaggaagtatggtgtagctgctgatcatattattgatgctcggatagtcaatgttgatgggaaaattctcgataggagaaccatgggaaaggaacttttctgggctattagaggtggtggaggatcaagttttggtgttgttctttcatggaaaatcaggttggttcctgttccacctactctgactgttttcagattatttaaaaccttggaacaaggtgcaactacactgctggaaaggtggcaatatgttgctcataaactccctagagaaatcttctttcaagttctcgtacgtaccgaaaattcgactgatgggaagaatacccgaagaatacaagcaagttttcaatctgtatttcttggcaaggcagaaaagctagttcctataatggaacaacattttccagaattgggattgaagcaagatgattgtattgaaatgagttggatacaatcaactctttggcttctaggtttgccggctgatggctcattggaagttttattaaataggagttctctaacctttgatactttcaaagcaaaaacagactatgttactgagcctatttcagtagctgggatagaaggggtgtggaaatttgtcttggaacaaaatagaccactattactccttactgcttatggtggaagaatgagcaaaattccagaatcttcaattccatttcctcacagaaaaggaaacttgtacaaattggcacaggttgtgtattgggaaggcgaggggaccgaagaaataaattggattagaagattgaatcgttacttgactccatatgtttccaaatctccaagggctacttatgtcaattataatgatctagacttgggccaaagcaaaaatggaacatcaagctactcagcagccagagcttggggcaacaagtacttcaagaacaacttcgatagattggtgaaggtgaagaccaaagttgatccagataatttcttcagaaatgcacaaagcattccaacctccgttaagtagaaaatagaaaaattatttactatagaatagcaataagatatacactgcctttcaagttgtagg

SEQ ID NO: 385 - DNA, 1483 bp, Mahonia aquifolium
cccaaaccaaacttcattgtcactcccatgcaagagtcccatgtccaaacatctgttatttgctgcagaaagcatggactgcagatgagaattcgaagtgggggtcatgattttgaaggcctatcttacgtatcaaatgtgccatttgttgtccttgatttgatacattttagaacaataagagttgatatcgaagataacagtgcatgggttcaaacaggtgctacaattggtgaactttactatcggattgctgagaagagtagggttcatgcatttccagcagggttgtgccccactgttggtgttggtggacacatcagtggagctggatatggtgtgttgatccgaaaatacggggtatcagctgaccatgtcatcgatgcacgtatagtgaacgctgacggagaaattctggatagagaatccatgggtgaagrtcttttttgggccatcagaggtggtggaggggctagttttggagtgatcctggcatggaaaatacgattagttcctgttccacctactgtgtctatcttcatagtctccaaaaccttggaagaaggcgcgaatgctcttcttcataagtggcagttcattggagacaatgtccatgaagatctttacatcggcatcagtatgcgccgcgagatcatcagtccaaaaggcgataaaacaatattagtttcattcataggccatttccttggtggttctgagaaactagtccaacacatggaacaaagctttcctgaattgggagtgaagcccaatgactgcgtcgaaatgagttggataaagtccgctgtggtttttggagttttctccaacgacgcattacttaatgtgttactagacaggaagaacccattcccaccaaaaagttaccacaaggtaaaatctgattatgtggcagaaccccttccagtaactgtactggaaggaatattgaaaaggtttcttaaaaatggaatcgataagcctgagattatcttgagtccttatggtggaaggatgaacgaaatttcagagtcggaaattgctttcccacacagaaaaggaaacctttataagatcaactatatagcagaatgggaagaagccgggagcatggaaaaacacttgagctggattagagagctatacgagtacatgactccttatgtatcaaagtcaccgaggtcttcatatctcaacttcaaggatatcgatttgggtcagatgaaaaatggtactgcaacctactcacaggctaaggcttggggtagtaagtacttcaagaataacttcaaaagattggtgcaagtgaagaccaaggttgatccaaacaatttcttctttaatgaacaaggcatcccaccttttcatcatagggcgaactgatgaaggaaaacaaaaatgctgtttttggcaacaagtgtgatagtttcattattttcatcaagttaataaggyattaaaattaccaggctaagtcaatccc

SEQ ID NO: 386 - DNA, 1935 bp, Nandina domestica
ctgacacatcccataaacatctccaatgggttcttcaaattttgccacactttcatttctttgtattttcttactgttagtgtcaacaagttcatgtgctgatgaagaaaatttcctccaatgcttagactttcattctcagaattctattccagtttacaccccaaacacttcttcctatagatcaatcttagaatccccaatatacaaccttagatttttatcatccacgttccggaaaccccttttcatcgtcacaccgatgcaagaatcccatgttcaaactacagttacttgttgtaaaaagcatgggttgcagcttagagttcgaagtgggggtcacgattttgaaggcctgtcttcgatatcgactgttccatttgttatacttgacttagtccatcataggtcgataaatgttgatattgaagataatagtgcatgggttcaagcaggtgctacaattggtgaactttattatcgaatcgctgagaaaagtaaggttcatgcttttccagcaggattgtgccctactgttggagttggtgggcacatcagtggtgctggctatggtgtcttgatcagaaaatttggcgtatcagctgattatgtgcttgatgcacgtatagttaatgctgatggtgaaattcttgatcgaaaatccatgggggaagatctgttttgggccttaagagggggaggaggagcgagtttcggtgtaattcttgcgtggaaaatacaactagtccatgttccaccaactgtgactattttcattattccgaagaccttagaacaaggtgcaacttctattcttcataagtggcaattcatcgctgataatgtcgatgaagacctcttcattggaatcagtatacgccccgaggacaaggtggatcccaaggaaggaaaaacaatactagtttcatttctaggcatattccttgggggtcctgaagaattactccaacatatggaccacagtttccccgaattgggactaaagcgccatgactgtatcgaaatgagttggatcaagtcagctgttgtttttggtgttttctcgactgaagtaccccttaacgccttactcgataagaagaaccctttcccaccaaaaagcttccacagggtaaaatctgattatgtgaaggaacctctttcagttactgtgttggaagagatatggagacgatttttggaaatgggagtacacaagcctgagattatcatgagtccctatggtggaaggatgaatgaaatttcagaatctgcgatcgctttccctcacagaaagggaaacatttataaaataaactatataattgaatggtttgacgaagagactaacacggcaaaaaagcatacaagttggataagagacttgtataaatacatgactccatatgtttccaaatcaccaagagcttcatatctcaatttcaaggatatcgatctgggtcacactaagaatggaactgcaagctattcagaagcttataaggcttggggtagtaagtacttcaagaacaacttcaaaagattgacgcaaatcaaggccaaggttgatcccaacaatttcttctggaatgagcaaggcattccacttctatcatcgtagtagagcgaaaaaagtttcagaggggccaaagatcgattgcagcaaaaacaatatatcagtattgctgattgggttattgtcacaatgtcttatgatcgtcttataagtcgtctaatgtttagcttttgtactaaagcaatgaatgaaaagtttgtgtaggatgcaggctaccatctaccttatgtattaagaaacactagggtatagcccggctatggtggggcatatttataagttcatattttttggtataattttgaaaaaaacatgtattctttttattttataggaaactctttatttttgagatcgga

SEQ ID NO: 387 - DNA, 1782 bp, Berberis thunbergii
atgtttgtggtggtggcttcttcaatctttacaacattttcactactttctttgttgttgccaacatcattggcatcttcggatgcaaattatgaagactttctccaatgcctagatctctattctcaaaattccattccagtttacacccgaaacacttcttcctatacatccatcttggagtcgacaataaaaaaccttgtattcctgtcacccaccacccccaaaccaaacttcattgtcacacccatgcaagaatcccatgtccaaacatctgtaatttgttgcagaaagcatggactgcaaatgagaattcggagtggaggtcatgattttgaaggcctatcttatgtatcaaatgtgccatttgttgtccttgatttgatacatcttaaaacaataaatgttgatattgaagaaaacagtgcttgggttcaaacaggtgctacaattggcgaactttattataggattgctgaaaaaagtagggttcatgcatttccagcagggttgtgccctactgtaggtgttggtgggcacatcagtggcgctggatatggtgtgttgatgcgtaaatacggcgtatcagctgaccatgtcattgatgcacgtatagtgaatgttgatggagaaattctggatagagagtccatgggtgaagatcttttttgggccatcagaggtggtggaggggctagttttggagtgatcctcgcatggaaaatacgattggttcctgttccacctaccgtgactatctttatagtccccaaaaccttggaagaaggtgccactgctcttcttcataagtggcagtttattggagacaatgtccatgaagatctttacattggcctcagtatgcgctccgtaatcatcagtccaaaaggcgataaaacaatactagtttcattcataggccttttccttggtggttccgacaaactagtccaacacatggaacaaagctttcctgaattgggagtaaagccccatgactgtatcgaaatgagttggatcaaatccaccgtggcttttggagttttctccaacgacgcaccacttagtgtgttactagacaggaagaacccattcccaccaaaaagctaccacaaggtaaaatctgattatgtgacagaacccctcccaatatctgtattggaagggatatgcgaaaggtttctgaaaaatggagttgataagcctgagattatcatgagtccctacggtggaaggatgaatgatatttcagagtccgaaattgcttttccacatagaaaaggaaacctttataagatcaactatatagcagaatgggaagaagcagggagcatggaaaatcatttaagctggattagagagctatacaagtacatgactccttatgtatcaaagtctccgaggtcttcatatctcaacttcaaggatatcgatttgggtcagactaaaaatggcacggcaacctactcacaagctaaggcttggggtagtaagtacttcaagaataacttcaaaagattgatgcaagtgaagaccaaggttgatccaaacaatttcttctctaatgaacaaggcattccacctttttcatcgtaggttgtgggggaaaaaacgttttctttgttggtaagaagtatcctagttttatattttcatcatgcaagttaaggtattaaatcccaggtttaagtcaatactcaagactgaatactaccaggtgtaaacgaaaaatacacccttgtataatctatatgatgtaggtatgtttttaagtaagtgatt

SEQ ID NO: 388 - DNA, 2029 bp, Jeffersonia diphylla
aaggtcatctataagaagtttcagtttgcataaattcaatttaacttagctcaatggctttttcagactcttctacagtaacattactttctatgatcctgacttttacgatatcatgggcagcttcagattcaagtcatgaaaattttctccaatgcctagatgtccattctcagaactctattccagtttacaagccgaacactacttcatatacatcaattttaaaatcctctgtgtataaccttaaattcttatcatccaccactgcaaaacccctgttcatcattacacccatgcatgaagcccatgtccaaacaactgttgtttgctgcaggaaacatagattacatattagaattcgaagtgggggtcatgatttcgaaggcctatcttatgtatcgagtgccccatttgttatccttgacttgttccatcttaaatcaattgatgttgatatagaagataacagcgtatgggttcaagcaggtgcaaacattggtgaactttattatcgaatagccgagaaaagtaaggttcatgcatttccagcagggttgtgccctactgtaggcgttggtgggcacataagtggagctgggtatggtgtcttggtgagaaaatatggcgtatcagctgactatgtggttgatgcgcggatagtgaatgttgacggtgaaatactggatcggaaatccatgggggaagatctcttttgggctattagaggaggtggaggagcaagctttggagtaattcttgcatggaaactacaattggtccatgttccggctaatgtgaccattttcatagtcccaaaaaccttggagcaaaatgcaactgctcttcttcacaaatggcaattcattggtgataacatccatgaagatctcttcattggaatcagtatacgtccggaagaagttgctccaaatggagaaaaaacaatactggtgtcctttctagccctattccttggtggtactgaaaaattgctcccactaatggaagaaagcttccctgaactcggactaaagccagaagactgtattgagatgagctggatcaaatcagccgtcacttttggcgttttctccaatgaagcatccctcaatgtcttgctagacaggaagaatcctttcccgccaaaaagcttccacaagataaaatctgattatgtgaaagaaccccttccgatagcggcactagaagagatatggagaaagtttctggaagtgggagtagagaagcctgagattataatgagtccttatggtggaataatgaatgaaatcccagagtctgcaatagcttttcctcataggaagggaaacatttataagattaactatattgtagaatggctagaagaagggactgaggcaaccaacaagcatgaaacttggattagagagctgtatagctacatgactccatatgtatcaaagtcaccaagggcttcatacctgaacttcaaagacattgatttgggtcagactaagaatggtagtgcaagctattctcaagctaagggttggggtaacaagtacttcaagaacaacttcaaaagattggtgcatgttaagactaaggttgatccagataatttcttctggaatgaacaaggtattccacctcagtcatcataggagcagagttagcaggatcaacgagatattatgatattttgagatatattggtttcttaggagggtttgataatattattaaatatcgaattatttctctgaaaattcagggagctccttagctcttcaacaaccaaatactctctccaacaatcaaatacctccaaagttttcctttttattttttccgctgaaaacctccaaagctttcctattgttgactcataggtcaatgtacagcaaactaagcacaagaggaaaaagaaggtataagtgtcctggcggtgtataccaaaattggggggaaatgacgaatataccccatatcggctagaatttatcctacaaagtcgaactgccaactagctttagactccttt

SEQ ID NO: 389 - DNA, 1961 bp, Menispermum canadense
aaacgcgtttaattctgttctatctatatgtaaggtgttcttcaggcccttctaagttacaagacaaacaaattaaagatgagtacttcaataccttcaatcttcacactcttctgtgtccttttgatttcaatttctagggcttcttcaagttctgctcatcaaaactttcttcagtgcctatccctccattctgatcaatctcccattccagtctacaccccaaacacttcctcttactcatcaatcttacaatattccatacaaaacctcaggttcataacacccaccactccaaaacctcagcttattgtgacaccatcacatgattctcatgtccaagcagcagtaatctgttgtaggaaacatgggttgcagatcagagttcgaagtggcggccatgattatgagggtctgtcttatatgtctgatgttccatttgtgattgttgatttgatcacttttcagtctattgatgttgatctagaagatggtagtgcttgggttcaggctggagcaactataggccaagtttattacagaattgctgagaaaactagggcatatggcttcccagcagggggttgtcccacattaggggttggtggtcactttagtgctgggggttttggctccctgttcaggaaatatgggcttgctgcagataacatcattgatgctagattagtgaatgctgatggccaaattttggataaagaatccatgggtgaggatcttttttgggctatcaggggaggaggagcagcgagctttggagtcattttatcatggaaaatcaagttggttcctgttccccctactgtgacgatattcagcatcggcaaatccttggaacaaggtgcaactgcacttgttcataggtggcaatacattgcatatgaactccccaaggacctgttacttgcagtcttcatgagaagggtgaatgcaagtcaagaaagagagggaacagtacaagcaacattcctatctgtgttccaaggaagaaccgaacaactcctccatataatggatcaaagattcccagagctgggtgtgaagagtgaagactgtatggaaatgagttggatacaatcttcactctacttagctggattcccaattgatggacctgcagatgttttgctgcagaggaatcaaagtagaagattcttcaaggcaaaatctgactttgtaaaggaacccattccagaaactgcgttggaaggaatatggaaaaggttttacgaagttgagactcctgagatgatcctggtcccttatggtggaaggatgagtgagattccagagtctgagcttccctactctcatagaaagggaaacatgtattcgatacaatatttggcatggtgggaacaagaagggccaaaggcggatacaaagaatgtaaattgggttagaaggtggtatagatacatggcaccttatgtttccaaatcaccaaggtctgcatatctcaactatagagatctagatttgggccagagcaagaatggtactgcaagttattcgcaagccagagtttggggcattaagtactacaacaataatttcgatagattagtgcaagtaaagagcaaggttgatccagacaacttctttaggaatgagcaaagcattccgtcagtaccagcaaggaaagagaagtagagataacccttttgacctagtgttctaaatacttaatgatcactctatgatagattatcaataaatacgaggcttctgtgtgctgcctcaatttcttgttctaaaaattgatcactctaaatactgaggtgatatatcatatatgtatattattagaattgaggttcatccaaaaacctgatttttttccttgttttcttgttattttcatgggtaaccatccctaccatgtcggtttttaaaaataagttatgccaaaagctttatcacttttcacaactacatgagtg

SEQ ID NO: 390 - DNA, 1673 bp, Cocculus trilobus
atctcatcaacacttttagtctcaatctttcacattcttgttttttcaatttcgttttcagcttcaaattcacccaattatgagagctttctcagttgcctatcaaaccattctcttgatcattctcacatcccaatctatctcccaaacacttcatcatacaattcaatcttaaactcttcaatacgaaatctcaggttctcatcaccccaaacccccaaaccacatctcataatcaaaccattgcatgaatcacatgtccaagcagccgtgatttgctctaagaaacatagctttcaaattagaacactcagtggaggccatgactatgagggcttatcattcacgtctcatctgaatctcccatttgttatacttgatctcttcaatttccaatccattaatgttgatgtcaaagatgaaactgcttgggttcaatccggtgcaacactaggccaattgtattacaaaattgcggagaagagcctaatccatggcttcccagctgggatttgcaccaccataggcgttggagggcacttcagtggtggtggatatggtactttgaagagaaaatatggcctcgcagccgacaacatcatcgacgctcgaatagtgaattctaacggcgaaatcttagatagagaatcaatgggggaagatctattttgggctatcaggggaggtggcgcagcaagttttggagttgttctatcatggaagatcaagttggttcaagttccccccactgtgactgttttcgcaatctcaaaaaccgtagaacaaggtgcaatttcacttttkcataaatggcaatacattgcacacaaactcccygaagacctcatgttactagttcagttaagaagagcaaattcgacaacacaagcgtcgtttcgatcgttgttcttaggaagaaaagagcaacttcttcagataatgcagraaagcttccctgaattgggtttgaagcgtgaagattgcatcgaaacgagctggattcgatctacactatttttttttgaccagcccttcaatgggtctttragtattttgcttgataggaattctataccaaaagttttcgccaaaataaaatctgattttgtgaaaaaaccaatatcggaagctgggttacaagggatatggagaaggtattctgaagtggacgacccagtaacgttaatcaccccatatggtggaaaaatggttgagattgcagaatctgcgattccatttccgcatagaaatgggaacatttatctaataggatatgaagtggactggacaaaaggaggggctgaggcatctacaaagcacatagggtggataaggaatttgtacgagtacttgacaccttatgtttcaaagtcgcctagagcttcgtatttgaattatagagatcttgatttgggtgaaaacaggattgatggtartgcaagctacgaagaagctaaggtttggggtgttaagtatttcaagagtaattttgataggttggtagaggtgaagagcaaggttgatccagataacttcttcagttatgaacagagcatcccaccacttcctaacaaaggggctagcacagcttatrgtacttttgtttatttatgtaygaaggartaagtaactttccttaaagtttaataatagatgcatgatgattataaatc

SEQ ID NO: 391 - DNA, 1770 bp, Tinospora cordifolia
gtacttcaaaatcaaacaggttttcgatgatcttactctcccacatcttcctgttctcaatttcatggtggtcttcagtacttgcccaagaaaacttcctccaatgcttatccctccattctgatcaacctccgattccagtctacaccccaaacacaatcttacttaactcaatcaatcctccaatcataccaatacaaaacctcaggtttatatcatcagataccccaaaacctcaagtgatcataacaccatcgcatgaatcacatgtccaggcagctgtgatttgttgtaggaaacatggattgcagattagagttcgaagcggcggccatgactatgagggcttatcttatacatccgatgttccattcgttgtagttgacttggcaaattttgaatccatcgttgtcgacgttgaagatagaagtgcttgggtccaagctggagcaaccataggtcaagtttattacagaatagctgagaaaactagtgcctatggcttcccagctggggcttgcccaacagtaggtgttggtggtcacttcagtgccggtggttatggtggcttgttcagaaaatatggacttgctgcagacaacatcattgatgctcggatcgtgaccgttgatggtaagatttcggataaggaatcaatgggtgaagatcttttttgggcaatacgaggtggtggaggagggagctttggagtcattttgtcatggaaaatcagactagttccggttccaccagttatgactctttccacagtcagtagaaggttagaacaaggtgcaactgaacttgtttataagtggcaaaacattgcacataaactccctgaagacttggtatttgcagtgttcataagaagggtgaatggaagtgaagaaacaaatgacaaaatacaagcaatattcctatctgtgttccaaggaaggactaaacaacttttacaaataatggaacaaaaattcccggagcttggtctgaaaagtgaagactgcattgagatgagctggattcaatctgccctttatttggcagaattcccatttgatggacctagagatgttttgctgaataggaaccaaagaagaagattgttcaaggcaaaatctgattacgtgaaggaaactattccagaaattgggttgaaaggaatatggacgttttttaatgaagtagatattcctgagatgatcttgagtccttatggtggacgaatgagcgagatttcggaatctgctcttccattttctcatagaaagggaaatttgtttaagatacagtacatagcatggtgggaaaaagcaggggctgaggaatccaagaagaacatcaattggattagaaggctctacaagtacatgactccttacgtatccaaatcaccaaggtctgcatatctcaactatagagatttagacttgggtcatagcgagaatggtacagcaagctatgaccaagcaagagtttggggaattaagtattttggcaacaattttgatagattagtgcatgtgaagagcaaggttgatccagaaaactttttcaggaatgagcaaagtattccatcagtgccagaaatgataatgaacacagagagctagacataatgatttagcctattgtttttaatagttaataattaattgatcactgtatgaagattctgtgtactgccttaattgctatttatgttccaaaatcctttctgatctatgttcacactagatttatacaacaattgaagtgtggattatttat

SEQ ID NO: 392 - DNA, 1831 bp, Cissampelos mucronata
cttgtttaaaatttatatcaaaatcatccatcaatcatcataagattatataagttgctgcatttcaagttcctaagcaacaaaaccagaaagatgggaatttccatctggagactatctctatttcaaatcctactgttcatcatttcatcggcagcttccgcgggaagagagaacattttccaatgcctatcaaaccattctacacaatctcctatcccgctctatgtatcaaacacaccatcctattccttaatcttgcagtcatccatccagaatctcttgttcttatcacccaagacgcctaaacctcttttcatcatcgcaccattgcatgaatcccatgttcaagcagctgtaatctgctgcagaaaacatgggctgcagatcaaaatacgaagtggaggccatgactttgagggtttatcatacatatcttacgttccatttgtaattcttgacttgttcaatcttaagtccatcagtattgatgtagaagatcaaacagcatgggttcaggccggtgctactctaggcgaactttactacaaaattgcggagaagactccgactctgggctttccagctgggatttgtcctacggtaggggttggaggccatctcagtggcggaggatatggatacttgatgagaaaatacggccttgcggcagataatattgtcgacgcccaaatagtgaatgttgaaggagaagttctaaacagagaatcaatgggggaagatctgttttgggccattagaggaggaggtggagcaaacttcggcgtcattctatcgtggaagatcaagttggttcctgtacctcctactgtcaccatttttagagttccgaagactttagaccaaggtgccaatggactagttcataagttgcaatatattgctcataaactccccaaagacctcatgcttgaagttctcacaggcagggcaaatgcaagccaagctgggaagaaaacaattctaattatatttcaggcattgttcttaggaggaagagagcaactgctcaggataatggagcagagcttccccgaattgggtttgaaggttgaagattgcgcggaaataagttggtttcaatctgctctaaacttctccggattaccaatgaatgcaactttgagcactctagcggtgaatccattcaaaggctcctacaaaataaagtccgactatgtgaaggatccaatttcggaaagtggattacaagggatatggaaaaatctcctggaagcagataggcttaatgtgcttatcacaccatacggcggaagaatgagtgagattgcagcctctgaaactccatttccccatagagaaggaaacatctatcagatttcttacttggttagttggaataaagaggaggcggcagaaaagagcataggctggctgagaaaattgtacaagtacatggaaccttatgtctccaagtccccaagatctgcttatctgaactacagagacattgatttgggtcatgagttcaagaatggtacctcaagctatgcaagagcaaaggtttggggttccagttactttgggaacaatttcgacaggttagtacaagtgaaaagcaaagttgatccatacaacttcttcaggaatgagcaaggcattccacctgttaactaggaggccttgcgtatgtgagtgctcgcacaccgatattttcctaatgttcaagtcttcgacttcttgggatgcatcaacatctattaataagagctctattcaatgaaattatgtaacaagttcaatgaaaatttagtgtgattgagcctagtacattagattaacatgcttc

SEQ ID NO: 393 - DNA, 582 bp, Papaver bracteatum
atgatgaggaaagtaatcaaatacgatatggaggtagctacctcagctgattcagtatgggcagtttacagttcaccggatattccaaggcttctcagggatgttctacttcccggcgtcttcgagaaattagacgtcattgaagggaatggcggcgtcggtacagttcttgacattgcttttcctccaggtgcggttcctcgaagttacaaagagaaattcgtcaacatcgaccgtgtaaagcgattgaaagaagtgatcatgattgaaggaggatacctggacatgggatgcacattttacttggacaggatccatgtcgtggagaaaaccccaaactcatgtgtcattgaatcctctattatctacgaagttaaagaagagtttgctgataaaatggctaagctaatcacaacggaaccattgcagtcgatggcagaagtcatctctggttatgttcttaagaaacgactccaagtatttggattcgagattaagccaaacttaagattcaatcttttgctatgtttgattatctgcttggttatagctggaggtatgttgattggacgtgttccataa

SEQ ID NO: 394 - DNA, 633 bp, Thalictrum flavum
atgatgaagatggaagttgtatttgttttcttaatgttgttaggaacaataaattgccagaaactgattctgacaggtaggccgtttctgcaccaccagggcataataaaccaggtgtctacagtcacaaaagtgattcatcatgagttggaagttgctgcttcagctgatgatatatggactgtttatagctggcctggcttggccaagcatcttcctgacttgctccctggcgcttttgaaaagctagaaatcattggtgatggaggtgttggtaccatcctagacatgacatttgtaccaggtgaatttcctcatgaatacaaggagaagtttatattagtcgataatgagcatcgtttaaagaaggtgcaaatgattgagggaggttatctggacttgggagtaacatactacatggacacaatccatgttgttccaactggtaaagattcatgtgttattaaatcctcaactgagtaccatgtgaaacctgagtttgtcaaaatcgttgaaccacttatcaccaccggtccattagctgccatggcagacgccatctcaaaacttgttctagaacacaaatccaaaagcaactcagatgaaattgaggccgcaataataacagtctga

SEQ ID NO: 395 - DNA, 696 bp, PSONCS1
atgtctaagttgatcacgacggaaccattgaagtcgatggcagaagttatctctaattacgctatgaagcaacaatctgtttctgagagaaacattcctaagaagcaatctctactgaggaaggaaattacttatgaaacggaggtgcaaacttctgctgattcaatttggaacgtctacagttctcctgacatccctcgactacttagagatgttctgcttcctggtgtttttgaaaagctagatgtcatagcaggcaatggtggagttggtacggtactggatattgccttccctctaggtgcagtgccacggaggtacaaggagaaatttgtgaagatcaaccatgagaagcgattgaaagaagtggtgatgatcgaaggaggatacttagacatggggtgcacattttacatggacaggatccatatctttgagaaaaccccaaactcatgtgttatcgaatcctcgatcatttacgaagttaaagaagagtatgctggtaaaatggctaagctaatcacaactgaaccattggaatccatggcagaagtcatctctggttatgttcttaagaaacgactccaagtattcggattcgagattaagccaaaattaagattcaatcttttgctatgtttgattatctgtctggttatagctggaggtatgtttgttgctggtgttccactctaa

SEQ ID NO: 396 - DNA, 696 bp, PSONCS2
atgtctaaattaatcacaactgaaccattgaagtcgatggcggaagtcatctctaattacgttatccagagagaatcattttccgcaagaaacattctcaacaaaaattctttggtgaagaaggagattcggtatgacctggaggttccaacctcagctgattctatctggtcagtttacagctgcccggatattcctcggcttcttagagatgttttacttcccggtgttttccagaaattggatgttatcgaagggaatggtggtgttggtacagttcttgatatcgtttttcctccaggtgcggtacctcgtagttacaaggagaaatttgtgaacatcaaccacgaaaagcgattaaaagaagtgattatgatcgaaggaggatatttagacatgggatgcacattttacatggacaggatccatatctttgagaaaaccccaaactcatgtgttatcgaatcctcgatcatttacgaagttaaagaagagtatgctggtaaaatggctaagctaatcacaactgaaccattggaatccatggcagaagtcatctctggttatgttcttaagaaacgactccaagtattcggattcgagattaagccaaaattaagattcaatcttttgctatgtttgattatctgtctggttatagctggaggtatgtttgttgctggtgttccactctaa

SEQ ID NO: 397 - DNA, 591 bp, CJANCS1
atgaggatggaagttgttctagttgttttcttgatgttcataggtacgataaattgtgaaagattgatattcaatggacgaccgctactccatcgcgtaacaaaagaggagactgtaatgctttatcatgagctggaagtagctgcttcagccgatgaagtgtggagtgtcgaaggttcgcctgagttgggcttgcatttgcctgacttgctccctgctggtatatttgcaaagtttgaaattactggtgatggaggtgaaggttcgatcctggacatgacattccccccaggtcagtttccacatcattacagggagaagttcgtgttcttcgatcacaagaatcgttacaagttagtagaacagatcgatggtgattttttcgatctaggtgttacatactatatggatacaatccgagttgttgcgacaggccctgattcatgtgtcatcaagtctactactgaataccatgtgaaacctgagtttgccaaaatcgtcaaaccacttattgacactgttccactagctatcatgtctgaagcgattgcaaaggttgttctagagaacaaacacaagagttcagagtaa

SEQ ID NO: 398 - DNA, 1116 bp, Papaver bracteatum
atgatgaggaaagtaatcaaatacgatatggaggtagctacctcagctgattcagtctgggcagtttacagttcaccggatattcctagacttctcagggatgttctacttcccggcgtctttgagaaattagacgtcattgaagggaatggcggcgttggtactgttcttgacattgctttccctccaggtgcggttcctcgaagttacaaagagaaattcgtcaacatcgaccgtgtaaagcgattgaaagaagtgatcatgattgaaggaggatacctggacatgggatgcacattttacttggacaggatccatgtcgtggagaaaactccgagctcatgtgttattgaatcgtctattgtttatgaagtggaagaagagtacgctgatgcgatgtcaaaattgatcacyactgaaccattgaagtcgatggcggaagtgatytctaattacgttattcagaaagaatcagtttccgcaagaaacattttcaacaggcaatctgtagtgaagaaggagattcattacgacctggaggtaccaacctcagctgattcgatctgggcagtttacagcaatcccgatatccctcggctacttagagatgttctgcttcctggcgttttcgagaaattggatgtcattgaagggaatggtggtgttggcactgttcttgatattgttttccctccaggtgcggtgcctcgttgttacaaggagaagtttgtgaccatggaccaccaaaagcgactaaaagaagtgattatgatcgaaggaggttacttagacatgggatgcacatcttacctggacaggatccatgttatagaaaaaacctctaaatcttgcatcattaaatcttctgttgtctacgaagtgaagcaagagtgtgctgaagcaatatctaagttgatcacgacggagccattgaagtcgatggcagaagtcatctcaaattatgttcttaagaaacaatctgtttccgacacaaacaatattgctaagaagcaatctgtgttgaggaaagaaattacttatgaaacggaggtgcaaacctcagctgattcgatttggaacgtctacagttctcctgacattcccccgactacttag

SEQ ID NO: 399 - DNA, 963 bp, Papaver bracteatum
atggatatcatagaaggggatggtggagttggtactgttcttgatgttgttttccaacctggtgcggtgcctcaaagttacaaggagagatttgagaccgtggaccaygmgaagcgaatactggaagtgagwattatcsaaggaggatacttagaaatgggttgcacatcttacctgaataggatgcatgttattgaaataacctctaaatcttgtgttattaaatcttcggttatctacgacgtgaaagaagagtgtgctgatgcaatgtctaagttaatcacaaccatacagttggagtcaatggccaaagtggtcgctgattatgttcttaagaaacaatctgcttctgacacaarcattcctaagaagcagtctctaatgaggaaagaaattacacatgagatggaggtgcaaacctcagctgattcgatttgggacatctacagttctcctgacatccctcgactacttagagatgtcctgcttcctggtgctttcgaaaagctacatgtcattcaaggcaatggtggggttggtactgtactggacatcgctctccctctaggtgcagtgccacgaaattacaaggagaaatttgtgaagatcaaccacgagaagcgactaaaagaagcagttatgattgaagggggatacgcagacatggggtgcacattttacatgcacaggatccatgtcctagagaaaacaccaaagtcgtgtgtcattgaatcctccatcgtttacgaagtgaaagaagagtatgctgataaaatgtcaaagctaatcacaacagaaccattgcagtccatggcagaagccatatctagttatgttcttaagaaacagttccaagtatttggattagaggttaaaccgaaattagtattaagtctatttctatgtttgatcatctttttggctatagttggtggttttttgattggaggtctaaaagcataa

SEQ ID NO: 400 - DNA, 831 bp, Papaver bracteatum
atgattgaaggaggatacctggacatgggatgcacgttttacttggacaggatccatgtcgtggagaaaactccgagctcatgtgttattgaatcgtctattgtttatgaagtgaagcaagagtgtgctgaagcaatatctaagttgatcacgacggagccattgaagtcgatggcagaagtcatcgctaattacgttcttaagaaacaatctgtttctgacacaaacattcctaagaagcaatctgtgttgaggaaagaaattacttatgaaacggaggtgcaaacctcagttgattcgatttggaacgtctacagttctccagacatccctcgactacttagagatgttctgcttcctggtgtttttgagaagctagatgtcattgcaggcaatggtggcgttgggactgtactggacattgctttccctctaggtgcagtgccgcggaggtataaggagagatttgtgaagatcaatcatgagaagcggttgaaagaagtggttatgatcgaaggagggtacttggacatgggctgcacattttacatggacaggattcatgtctttgacaaaaccccaaactcatgtgtcattgaatcctctattatctacgaagttaaagaagagtatgctgataaaatggctaagctaatcacaacggaaccattgcagtcgatggcagaagtcatctctggttatgttcttaagaaacgactccaagtatttggattcgagattaagccaaacttaagattcaatcttttgctatgtttgattatctgcttggttatagctggaggtatgttgattggacgtgttccactctaa

SEQ ID NO: 401 - DNA, 1599 bp, Papaver bracteatum
atgatgaggaaagtaatcaaatacgatatggaggtagctacctcagctgattcagtctgggcagtttacagttcaccggatattccaaggcttctcagggatgttctacttcccggcgtcttcgagaaattagatgtcattgaagggaatggcggcgttggtactgttcttgacattgctttccctccaggtgcggttcctcgaagttacaaagagaaattcgtcaacatcgaccgtgtaaagcgattgaaagaagtgatcatgattgaaggaggatacctggacatgggatgcacattttacttggacaggatccatgtcgtggagaaaactccgagctcatgtgttattgaatcgtctattgtttatgaagtggaagaagagtacgctgatgccatgtcaaaattgatcaccactgaaccattgaagtcgatggcggaagtgatttctaattacgttatccagaaagaatcagtttccgcaagaaacattttcaacaggcaatctgtagtgaagaaggagattcgatacgacctggaggtaccaacctcagctgattctatctgggcagtttacagcaatcccgatatccctcggctacttagagatgttctgcttcctggcgttttcgagaaattggatgtcattgaagggaatggtggtgttgggactgttcttgatatcgtttttcctccaggtgcggtgcctcgtcgttacaaggagaaatttgtgaacatcaaccacgagaagcgattaaaagaagtgattatgatcgaaggagggtacttagacatgggatgcacattttacctggacaggatccatgttgtagaaaaaacctctaaatcttgcatcattaaatcttctattgtttacgaagtgaagcaagagtgcgctgaagcaatatctaagttgatcacgacggagccgttgaagtcgatggcacaagtcatcgctaattatgttcttaagaaacaatctgtttctgacacaaacattcctaagaagcaatctgtgttgaggaaagaaattacttatgaaacggaggtgcaaacctcagttgattcgatttggaacgtctacagttctccagacatccctcgactacttagagatgttctgcttccgggtgtttttgaaaagctagatgtcattgcaggcaatggtggcgttgggactgtactggacattgctttccctctaggtgcagtgccgcggaggtacaaggaaaaatttgtgaagatcaaccatgagaaacgattgaaagaagtgattatgatcgaaggaggatacttagacatggggtgcacattttacatggacaggattcatgtacttgagaaaaccccaaactcatgtgtcattgaatcctctattatctacgaagttaaagaagagtttgctgataaaatggctaagctaatcacaacggaaccattgcagtcgatggcagaagtcatctctgcttatgttcttaggaaacgattcgaagtatttggactagagattaagcaaaaattaagatacaatcttttgctatgtttgattatctgcttggttatagctggaggtatgttgattggacgtgttccactctaa

SEQ ID NO: 402 - DNA, 582 bp, Sanguinaria canadensis
atgaggaaggaactgacacacgagatggaggtgcctgcctcagccgatgctatttgggcagtctacagttcacatgatattccaaggctgctcaaagaagttttgcttcctggtgtttttgaaaagctagatgtcattgcaggtgatggtggtgttggtactgttctcgacattgctttccctccaggggcggtaccgcgtcgttacaaggagaaattcgtgaagatcaatcacgagaagcgattgaaggaagtggagatgatcgaaggagggtatttggatatggggtgtacattttatatggacaggattcatgtcgtagagaaaggtcctaattcatgcgttatcgaatcggcgattatttacgtagtgaaggacgaatgcgccgatgtcgtcgttcctctaattacgactgaaccactggctagcatggcggaggtcatctcaaattacgttctaaggaaacaaatccgattgtttggatacgtaattaaaccaaaattagggttaagtattttgctctccttgattctctgcctagttatactaggagtgttattgattggaggtgttccattctaa

SEQ ID NO: 403 - DNA, 798 bp, Chelidonium majus
atgattgaaggagggtatttggatatgggatgtacattttacatggacagaatccatgttgtaaagaaaggtcccaattcatgcgttattgcatcggctattatctacgaggtgaaggaggaatttgtcgacgtcgtcgttcctctaatcacgaccgaaccattggctagcatggcagaagtcatctcaaattacgttcttaagaaacaacgtcgtgtaaggaaggaactaacatatgagatggaggtgcctacctcagctgattcaatttgggcagtctacagttcacatgatattccaaggctcctcaaagaagttctgctccctggtgtctttgaaaagcttgatgtcattgaaggtgatggtggtgttggtactgttcttgacattgctttcccaccaggggcggtaccacgcacttacaaggagaaattcgtgaagatcaatcacgagaagcgattgaaagaggtggtgatgattgaaggagggtatttggatatgggatgtacattttacatggacagaatccatgtgctagagaaaagtcctaactcgtgcgttattgaatcttctattatctacgaggtgaaggaggaatttgccgatgtcgtgggtcctctaatcacgaccgagccactagctagcatgtcagaggtcatctcaaattacgttctaaagaaacaaatccgcatgtttggttatgtaattaaaccaaaacttggtttaagtcttttgctctgcttcattctctgcctcgttttacttggagttttattgattgggggtgttccactctaa

SEQ ID NO: 404 - DNA, 1056 bp, Stylophorum diphyllum
atgaggaaggaagtacgatatgagatggaggtacctacctcagctgattcaatttgggcagtttacagttcacatgatattccaaggctcctcaaagaagttcttctccctggtgtctttgaaaagcttgatgtcattgaaggtgatggtggtgttggtactgttcttgacattgctttcccaccaggggcggtaccacgcacttacaaggagaaatttgtgacaatcaatcatgagaagcgattgaaagaggtgattatgattgaaggagggtatttggatatgggatgtacattttacatggacagaatccatgtcctagagaaaggtcccaaatcatgcattattgcatcggctattatctatgaggtgaaagaagaattcgccgatgtcgtcgttcctctaatcacgactgaaccattggctagcatggcagaggtcatctccaattacgttcttaagaaacaacgccgtgtaaggaaggaattaacatatgagatggaggttcctacctcagctgattcaatttgggcagtttacagttcacatgatattccaaggctcctcaaagaagtccttctccctggtgtgtttgaaaagcttgatgtcattgagggtgatggtggtgttggtactgttcttgacattgctttccctccaggtgcggtaccacgcacttacaaggagaaattcgtgaagatcaatcacgagaagcgattgaaagaggtggtgatgattgaaggagggtatttggatatgggatgtacattttacatggacagaatccatgtcctagagaaaggtcctaattcttgcgttattgaatctgctattatctacgaggtgaaagaagaatttgctgatgtcgtcgttccactaatcacgaccgaaccactagctagcatggcagaggtcatctcaaattacgttctaaagaaacaaatccatgtgtttggttatgtaattaaaccaaaacttggattaagtcttttgctctgcttcattctctgcctcgttttacttggagttttattgattggaggtgttccactctaa

SEQ ID NO: 405 - DNA, 855 bp, Eschscholzia californica
atgatcggaggattcttagacatgggatgtacattttacatggacaggattcatgtcgtagcgaaaggtcctaattcatgtattatcaaatcgactcttatctacgaagtgaaagaggaatatgccgatgccatggcttctctaatcactgtagaaccactagctagcatggcagaagttgttgcaaattacgttcttcatcaacaagtccgggtgttaggatccgtgaagaggaaggaacttacgcatgagttggaagttgctgcaccagctgatgctatttggggtgtgtatagctcacctgatattccgaggcttctgagggatgttttgcttccgggtgtttttgaaaagttagaagttatacaaggaaatggaggtgttggtactgttcttgagattgttttccatccaggtgcaattccgcgtaggtacaaggagaagtttgtgacgataaatcacaagaagcgactgaaagaggtggtcatgattggagggtatctagacatggggtgtacactttatatggacaggattcatgtagtatccaaaggtcctaattcatgtgttatcaaatcgacactcatttatgaagttaaagcagaatcagcagatgcgatggcttctacaatcaccatcgacccactcgctagcatggcacaggtcatctcaaattatgttctcaagaatcaaatgcaagtcttaggatctgttaagagaagggaattaacacatgagttagaggtagctgcctcagctgacgctatttggggagtttatggatcaaaaagatattccaaggcttctcagggatgttttgcttcctggtgttttcgaaaagttagaagtcattga

SEQ ID NO: 406 - DNA, 2259 bp, Eschscholzia californica
atgatcggagggtacctagacatggggtgtactctttatatggacaggattcatgtggttgagaaaggtccaaactcatgtgttataaaatcgacacttatttatgaagtgaaagcagaatatgcggatgccatggcttctctaatcacagtcgacccactcgctagcatggcacaagtgatctcaaattatgttctcaagaatcaaggccaagtcttaggatctataaagagaagggaactaaaacatgaattggaggtagctgtctctgctgatgctatttggggagttattggttcaaaagatatcccaaggcttcttagagatgttttgcttcctggtgtttttgagaagttagatgtcattgaaggtgatggaggcgtgggtactgttcttgaaattgttttccctccaggagctgttccgcgaaaatacagagagaagtttgtgaaggtcgatcatgagaaacgactgaaagaggtgatcatgatcggagggtacttagacatgggatgtacattttacatggacaggattcatgtcgtagcgaaaggtcctaattcatgtattatcaaatcgactcttatctacgaagtgaaagaggaatatgccgatgcaatggcttctctaatcaccgtagaaccactagctagcatggcagaagttgttgcaaattacgttctccatcaacaagtccgggtgttaggatccgtgaagaggaaggaacttacacatgagttggaagtagctgcatcagctgatgctatttggggtgtgtatagctcacctgatattccgaggcttctgagggatgttttgcttccgggtgtttttgaaaagttagaagttatacaaggaaatggaggtgttggtactgttcttgagattgttttccatccaggtgcaattccgcgtaggtacaaggagaagtttgtgacgataaatcacaagaagcgactgaaagaggtggtcatgattggagggtatctagacatggggtgtacactttatatggacaggattcatgtagtatccaaaggtcctaattcatgtgttatcaaatcgacactcatttatgaagttaaagcagaatcagcagatgccatggcttctacaatcaccatcgacccactcgctagcatggcacaggtcatctcaaattacgttctcaagaatcaaatgcaagtcttaggatctgttaagagaagggaattaacacatgagttagaggtagctgcctcagctgacgctatttggggagtttatggatcaaaagatattccaaggcttctcagggatgttttgcttcctggtgttttcgaaaagttagaagtcattgaaggcgatggaggtgttggtactgttctccaaattgtttttcctccaggggcaattccacggaggtacaaagagaaatttgtgaaagtcgatcagaagctgcgactaaaagaagtgatcatgatcggaggatacttggacatgggttgtacgttttatatggacaggattcatgtagtaccaaaaggtcttaattcatgtgttatcaaatcaacacttatttatgaagtgaaagatgaatatgctgatgccatgtcctctcttatcactgtcgagccactcgctagcatggctgaagttgtttcaaattatgttctgaataaaaagaaactaatgataacaaggaaagaactaacacatgagttggaggtggcagcctcagccgatgctatttggagtgtctatagctcacctgatattccaaggcttctcagagatgttttgcttcctggcgtttttgaaaagttagaagttgttcaaggaaatggtggcgttggtactgttctcgaaattgttttccctaaaggatctgttccacggaggtacaaagagaagtttgtgaaaatcaacgacgagaaaaagctgaaagaggtaatcatgatcgaaggaggatacttggacttgggatgtacattttacatggacaaaattcatgtcttacctaaagggcctaattcatgtgttatcgaatcgtcacttatttacgaagttaaagaagaaaatgcaaaagccatggcttctctgattactgttgaaccacttgctagcatggctgaagtcgttgcaaattacgttcttaagaagcaaatccgtgtgttaggatacgtcgttaagccaagagttggatatagtgttttggttgggcttttactctgcttggttctacttggagttttattgctttcaggtgtcaacatctaa

SEQ ID NO: 407 - DNA, 522 bp, Argemone mexicana
atgaggaaagaagttgtatatgaattggaagtaccaacttcagctgattcaatatgggcagtttacagttcacccaacattcctacacttctaagagatgttctacttcctggtgtttttgagaagttagatgtgattgagggtaatggtggtgttggaactgttcttaacattgttttccctccrggtgctgtkccccgkwgttacaaagagaaattcattaatatcgacaacaagaagaggttaaaagaagtgattatgatcgaaggaggctatttagacatgggatgtacattttacatggataggatccatgttatagcggaaactcctaattcttgtgttatcaaatcatctatcatttacgacgtgaaaaaagagtatgccgaagctatgtctaaactaatcacaaccatacctttgaaatccatgtctgaagtcatcgctaattacgttctcaagaatcaatctgtgataagaaaggaagttacatatgaactgcaagtgccaacctcagactga

SEQ ID NO: 408 - DNA, 471 bp, Argemone mexicana
atgaagtttgagctagtaaatgagttagaggtgcctgcctcagcaaatgatgtatgggcaatttatagctcacctgatttccctaaactccttacgaagttggttccaggtattctggagagtgtagaatacgtcgaaggcgatggtcatcttggaactgttattcatcttgtatacgttcctgggagtgtgccacttagttacaaggaaaagtttgtgacgatcgaccacgaaaaacgtttgaaagaggcagtgcatgtcgaaggaggattcctagagatgggtgtaacattttacatgaacagcttcgaaattattgagaaaggttcggattgttgcataattaggtcaatgactaagtgcgaaattgaggataaagaaatcatgaacctaatttctcatattagtgttgcaaatgtgaccgtccttgcaatgactatctcaaaatatgttcaacaacacaagaaataa

SEQ ID NO: 409 - DNA, 657 bp, Thalictrum flavum
atgaagatggaagctactgtatttgtttttttaatgttcttaggaacaataaattgtcagaaattgattatggcaggtaggccgtttcttcatcaccagggcataataaaccaggagtttacagttacaaaagtgcttcatcatgagttggaagttgctgcttcggctgatgatatatggggtgtttatagctcgcctcacttggtttttcatctcactgacttgctccctggtgcttttgaaaaggtccaagtcattggtgatggaggtgttggtactattctagacatgacatttgcaccaggtgaatttcctcatgaatacaaggagaaatttattgtagtcgataatgaacatcgtttaaagaaggtgcaaatgatcgagggaggttatctggacttaggagtaacatactacatggacacaatccaggttgttccaactggtacaaattcgtgtgtcattaaatcctcaactgagtatcatgtgaaacctgagctactcaaaatcgttgaaccacttatcaccactggtccagtagctgccatggcggaagccatctcaaaacttgttctagaatacaaatacaaaagtcactcagacgagattcatgctggcctcaataacaatctaaagatggtgatcaataatatataa

SEQ ID NO: 410 - DNA, 657 bp, Thalictrum flavum; identical to SEQ ID NO: 409

SEQ ID NO: 411 - DNA, 582 bp, Thalictrum flavum
atgaggaaggaactaacacatgagatggaggtacctgcctcagctgatgctatttgggcagtctatggttctcctgatattcccaggctcctcaaagaagttttgctcccaggtgtctttgaaaagctggatgttattgaaggtgatggtggtgttggtaccgttctcgatattgctttcccaccaggagcggtgccgcgtgcttacaaggagaaattcatgaaggtcaatcacgaaaagcgattgaaagaggtggagatgatcgaaggagggtatttggatatgggttgtacattttacatggacagaatccatgtcgtagagaaaggtcctaatgcctgtgttattgaatcggctattatatatgaagtgaaggatgaattcgccgacgttgttgttcctctaatcacaactgaaccactggctagcatggctgaggtcatctcaaactatgttctaaagaatcaatttcgcgtgttcggctatgtaattaaacctaaactcggattaagtcttttgctctgcttcattctctgcctcgttttacttggagggttgttgattggaggtgttccactctaa

SEQ ID NO: 412 - DNA, 492 bp, Thalictrum flavum
atgaggaaggaacttacaaatgagatggaggtggctgcgtctgctgacgaaatttgggcagtctacagctcccccaacctccccaaactcatcgttcaattacttcctgctgtctttgaaaggatatatatccttgaaggagatggtggtgttggtaccgttctctatattttatctcctccaggatcggttccgcgtagttacaaggagaagttcattacaatcgatcatgagaagcgtctgaaggaggtgcaagagatcgaaggagggtacttggacatgggcgttaccttttacatggacaccttctacatcttagagaaaggtcctgattcctgcatcatcaaatccatgactacctacgaaatcaaggatgagctggccgataaagttgcttctcttattagcattgattcactagttggcatggctaaagccatcacaaaatatgtccttgatcagaagaaagctgctgtggattcttctgcctag

SEQ ID NO: 413 - DNA, 486 bp, Berberis thunbergii
atggtagtggctgcctcagctgatgatgtttgggcaatctatagctcccatgatctgcccaaactcattgtgaagttgcttccaagtgtctttaagagcatagaaattgttgaaggtgatggaggtcttggtacagttttggatgttaaataccctccaggatcaataccactacattacagggagaaatttataacaatcgataatgaaaaacgtcttaaagaagtgagacaaatcgaagatggacttctggctttaggatgcacattctacatggacagcttccatatccttgagaaagattgtcaccatgaattcttccatatccatgagaagaactgtcataagaaatgtatcatcaagtcgactacagtatatgaggtacctgatgagttagcttataaaatcgaacctctagtcaccattgattccctggttggtatggctcatgccatctcaaaatatgttcttgacaaatcgtgttaa

SEQ ID NO: 414 - DNA, 1461 bp, Corydalis chelanthifolia
atgtactacttcctggagttcttcgaaaaactagatgtcattgaaggcaatggaggcgtcggcactgttcttgacattgcttttcctccaggggcagtaccacgtagctacaaggagaagttcgtaaaggttgaccacaagaaccgtttgaaggaagtcgtgatgatcgaaggaggatatttagatcttggatgtacattttatatggatagaatccatgtcttaccaaaaggtgcaaattcatgcgtaatcaagtcgaccctcatttacgaaattccagatgagcttgtcgactctgttggttctcttatgtctactgaaccactagcaagcatggcaaaagtcatctcggattacgttctcaagcagagaaagatgacagcaaacaaaatattgaggaaggaattaaaaacagagatggaggtggctacttcagctgattctatatgggcagtctacggttcccctgacattcctagactcctcagagatgtattacttcctggagtttttgagaaactggatgtcattgaaggcaatggaggtgtcggcactgttcttgatattgcttttcctccaggggcggtacctcgtacttacaaagagaagttcgtaaaggttgatcacaagaaccgtttgaaggaagtcgtgatgattgaaggcggatatctggacttaggatgtacattttatatggatagaatccatgtcttaccaaaaggtcctaatacatgcgtaatcaaatcgactcttatctatgaagttccagacgagttcgctgatgcagttggttctcttatctccgttgaaccactagcaagcatggcagaagtaatatcaggttatgttctcaagcagaagaaggaagcaaagaaaatattaaggaaggaattaacacacgaattggaggtgcctacttcagctgattcaatatgggcagtctatggttcccctgatattccaagattgctcagagatgtattacttcctggtgtgtttgaaaagctagacatcgtggaaggcaatggaggtgttggtactgttcttgacattgcttttcctccaggggcggtacctcgtagttacaaggagaagtttgtaaaggttgatcacgataagcatttgaaagaagttgtgatgatcgaaggaggatatttggatctaggatgcacattctatatggatagaatccatgtcctaccgaaaggtcctaattcttgtgttatcgaatcgtctcttatttatgaagtccgggaagagctcgctgatgtcgttggttctcttatctcaattgaaccacttgctagcatggcagaagtcatctcaagttatgttctcaaacaacaactccgagtgtttggagttgtagttcaaccaagagtaggattaagtcttttgctctgccttatactgtgtctagtcatattaggaggtcttttgatcggcggtgtttcgatataa

SEQ ID NO: 415 - DNA, 1119 bp, Corydalis chelanthifolia
atgaggaaggaattaagacatgaattggaggtggcaacttcagctgattctatttgggcagtctatggttcccctgatatcccaagacttctcagagatgtattgcttcctggtgtctttgaaaaactagatgttattcaaggcaatggaggtgtgggtactgttcttgacattgctttccctccaggggcggttccacgtacttacaaggagaagttcgtaaaggtcgatcacaagaatcgtttgaaggaagttgtaatgatcgaaggaggatatctggacctaggatgtacattttatatggatagaatccatgtcttgcccagtggacctaatacatgtataatcaaatctacacttatttacgaagttccagacgagctcgcctactccgttgcttctctaatctctgttgaaccactagcaagcatggcagaagtcatctcaggttatgtgctcaggcagagaaagatgacaacaaacaaaatattgaggaaggaattgacaacagagatggaggtgcccacttcagctgattcaatatgggcagtctatggttcccctgatattcctagactccttagagatgtattacttcctggagttttcgaaaggctggatgtcattgaaggcaatggaggtgtcggcactgttcttgatattagttttccaccaggggcggtaccacgtagttacaaggagaagtttgtgaaggttgatcacaagaaccgtctgaaggaagttgtgatgatcgaaggaggatatctagatctaggatgtacattttatatggatagaatccatgtaataccaaaaggccctaattcatgcgtaatcaagtcgaccctcatttatgaaattcctggtgagcttgtggactctgttggttctcttatgtctactgaaccacttgcaagcatggcagcagtcatctcggattacgttctcaaacagagaaagatgacagcaaaccaaatattgaggaaggaattgacaacagagatggagttggctacttcagctgattctatttggtcagtttatggttcccctgatattcctagactcctcagagatgtattacttcctggagttttcgaaagactaggatgtcattga

SEQ ID NO: 416 - DNA, 600 bp, Corydalis chelanthifolia
atgatgaggaaagaactagtacatgaaaaggaagtgtgtgcatcagctgatgcagtatggggagtgtatagttcacccaatattccaacactccttagagataaattacttcctggtatgtttaaaaggcttgagatacttgaaggtgatggaggagttggtacaattctcctccttgagttcaataatccagcgattataccacatacatatcttgaaaagttcatgaagctagatcatgagaagcgtttgttggaagttgaggtggtcaaaggaggatatttggatttaggatgtacattttatatgagtagaatacacatcttggagaaaggtcctaattcatgcgtaatcgaatcgactcttattttcgaagcaccggaggaactcatggaatatgttagtcaatatgcaaaccttgaatcattaattagcatggcagaagttatatcaaagtatgttcttgagcagcaattccgagttttcggagttgttgtcaagaaactgaaattgggattatcaactattgtgttgctatgcatttttatctttctggttattgtattaggaggtctttggattgaaggtgtttcaatctaa

SEQ ID NO: 417 - DNA, 480 bp, Corydalis chelanthifolia
atgaggaagcatcttgttaacgagttggaggttgttgttccagccgacactctttgggcaatttacagcaccactcaattcccaaagctaattgttcaattgcttcccattgttgtccaaaatatagaaattgatggcgacggaagtcttggtactgttttgaatgttatttttgttccaggatcggttccattgtcttacaaagagaaaatcgtgacgattgatcatgagaagcgtttgaaggaagtggtgcagatcgaaggaggatatttggatttaggatgttcattttacatgagcagctttcaaatcttggagaaaggtcgtgattcttgcatcatcaaatccatggttacatacgagctggctaaggatgctgatcctagtgttgctgatttggtcaccattgctgcacatgctgccatagctcaagtcatctctaagtatgttcttgacaaacaagtagccgcagctccataa

SEQ ID NO: 418 - DNA, 543 bp, Corydalis chelanthifolia
atgaggaaggaactcacaaatgagttggaggtcgcagcccctgctgatgctgtctgggcagtttacagctccccggatctcccaaaaatcatasttgaattacttcctagtgtcttcgaaaagattgaaatcgttgaaggagacggaggtgttggtaccgttctgtacgttgtttttcctccaggatcagttccattaacttacaaggagaagttcgtgacgattgatcacgagaagcgtctgaaggaggtgctacagattgaaggaggatatttggacctagggtgtacgttttacatggacagcttccatatactagagaaagattgtgattcatgcatcatcaaatccataacagcatacgaagtcagggatgatgttgttgataatgtttcctctcttatctccattgattcgctcgctaacatggctgaagccatctcaaagtatgtccttgagaaacaagaagccgcaactaagcatggacatggagatgatagggaaaggactggtctttgttggcctttcaattgtttgggttaa

SEQ ID NO: 419 - DNA, 594 bp, Nandina domestica
atgaggaagggaattgttttcctatttctagttttcttaggatgtgaagtttcacaaggaaggcaactgctagagtcgagattatttaggaaatctacgatacaaaaagttcttcaccatgagttgccagttgctgcgtcggcccaagaagtgtgggatgtttatagctcgcccgaattgccaaaacacctaccagaaatacttccaggcgcattcgagaaagttgtagttaccggggatggtggtgttggtactgtacttgaaatggtatttcctccaggagaagtaccccgtagttacaaggagaaatttgtgttgattgatgacgaacagcttttgaagaaggtcgaaatgattgaaggtggatatttggacatgggatgtacgttttatatggacacaatccaaatcgttccaacaggtcctgattcatgcataatcaaatcctcaactgaatactacgttaaacctgaatttgcggacaaggttgtacctcttatcagcacaatcccattgcaagccatggccgaagctatctcgaacattgttctagcaaacaaagccaagaacaagagtattatcatcgaaatataa

SEQ ID NO: 420 - DNA, 456 bp, Nandina domestica
atggtatttcctccaggagaagtaccccgtagttacaaggagaaatttgtgttgattgatgacgaacagcttttgaagaaggtcgaaatgattgaaggtggatatttgaacgatttggattgtgtccatataaaacgtacatcccatgtccaaatatccaccttcaatcatttcgacatgggatgtacgttttatatggacacaatccaaatcgttccaacaggtcctgattcatgcataatcaaatcctcaactgaatactacgttaaacctgaatttgcggacaaggttgtacctcttatcagcacaatcccattgcaagccatggccgaagctatctcgaacattgttctagacaaaacaaaagaccaaagaaacaaagaagtaattaatacaaatacgaaaaataataaaatacatcatcgctatgtcgctaccattgttataatcagataa

SEQ ID NO: 421 - DNA, 456 bp, Nandina domestica; identical to SEQ ID NO: 420

SEQ ID NO: 422 - DNA, 447 bp, Nandina domestica
atggaagtggctgcgtcggcgggtgatatttgggctgtttacagttcccctgatctgcctaggcttatcgtccaattactccccactgtgtttgaaaagatagacattgtagaaggcgatggaggtgttggtactgttttacatattacatttcctcccggatctgtaccgcttacttacaaggagaaatttgtgacgatcgataatgcaaaccgtttaaaagaagtactacagatcgaaggtggatatttggagttgggatgtactttctatatggatagcttccagatcttcgagaaaggtattgattcatgcatcatcaaatcaatgactacttatgaagtaccagatgagcttgcagacaaagttgctcctcttatctccattgattccctcgttcccatggctgaagccatctcaaaatatgttattgagaagcgtcattaa

SEQ ID NO: 423 - DNA, 465 bp, Cocculus trilobus
atgatcaagaaggaactcaaacacgagatgagagtggctgcctctgcagatgatatatgggcagtttacagctcacctgatttgcccaatctcatcctcagattgctacctagtgttttcgacaacatcgaaatcgtcgaaggcaacggaggagtcggaactgttctccacctcacttttcctccaggttcagtaccactttcatacaaggagaagttcgtgactattaatggcaacaaacgtttgaaggaggtgaagcagattcaaggagggtatcttgacatgggctgcacattctacatggacagctttcatatagaagagaaaggttgtgattcatgtgtgatcgtgtcgaagaccgagtacgaagtacctaatgaggagatagcaaaccaagttgagctttatatatctattgattcactagctagcatggcccaaggccatctcggattatgttcttag

SEQ ID NO: 424 - DNA, 618 bp, Hydrastis canadensis
atgaagatggcaattttgtttgtgttcttaatgttcttgggaaagatgaattctgaaggcttgcacttgagcgggaggccgcttctccgggcgataatatccgacaagcccaatgtaatcaaagtgcttaaacatgagttggcagtacctgcatccgcggacaaagtttgggcagtctatagcgcgcccacgttggccttccatctcagcgacttacttcccggtgcctttgaaaaggtggaagtttttggtgatggaggtgttggcactatcatcgacatgacatttgccccaggtgaatttccccatgaatacaaggaaaaattcatcttgatagatggcaaacaacgtctaaagaaagtacaaatgatcgaaggaggttatttggatctaggagttacatactatatggacaccatccatgtcgtcccaacaggttccaattcatgcatcatcaaatcatctactgaataccatgtaaaacctgaggccgcaaagctagtcgaacctcttatcacaactgagccattagctgccatggctgaagttatcacaaagattgtcttagagaacaaaagcaagagctccgaagaaaatcagtcatcagaagccatataa

SEQ ID NO: 425 - DNA, 690 bp, Nigella sativa
atggttcagttcagcagagaaagcaagcaaataagcattatctctgacgaagaagaaggaggagaagaagaaactaaggagaagaagatgatgaaggtacaagtagcacttgctttcttactaatattaggtgctgcaagctgccaagaactcatactgcagggaaggccgcttcttggtggtgcccgcgcgtggggtaccaaatccataaagaaagagctgaaacacgagttcaaagttgctgcttcagctgatgaggtttggagtgtgtatagcgcaccagaactctgcaaacatctcactgatcttctcccaggtgcatttgaggatgttgaaatcattggtgacggaggcgttggtaccattcttcacatgattttccctccaggtgaattcccgcatgaatacaaggagaagtttgtggtgattgatgacaagcaacggttaaagaaggtagaaatgatcgaaggtgggtatctggatattggagtgacttactatatggacaccatccatgttgtgcccactggttcagactcatgtgtgattaagtcatccacagaataccatgtaaaacctgagtttgagaaaattgtggaaccacttattactacagttccattagctgccatggctgaagctatcgccaagattgttctagacaacaaaactcattccattacaatctga

SEQ ID NO: 426 - DNA, 600 bp, Nigella sativa
atggtgaagatacagttagtgcttgcttgtttactactagtagtaggtgctgtaaattgccaaaagcttatattgcaggggaggccacttcttggtgcctgggcgtgtggtaccatcaagaaagtgctgaaacatgagttcaaagtagctgcttcagctgatgaggtgtggagtgtgtacagctcaccagaactctgcaaacatctaactgatcttctcccaggtgcatttcaggatcttgaaattattggtgatggaggcgttggtaccattctccacatgacttttccaccaggtgaattcccacatgaatacaaggagaaatttgtgttaattgatgacaagcgaaagttaaagaaggtagaaatgataaagggtggctatttggatattggagtgacttactatatggacaccatccatgttgtgcccactggttcagattcatgtgtgatcaagtcgtccacagaataccatgtaagacctgagtgtgagaaaatagtggaaccacttattaccactgaaccattagctgccatggctgaagctgtctccaagattgttctagatgccaaaattcattccataataacaatctga

SEQ ID NO: 427 - DNA, 936 bp, Menispermum canadense
atgatcaagaaggagctcaagcatgaattggaggtagctacctctgcggacgaaatttgggaagtatacagctctcctgatttgcccatccttattgttaaattgcttccaagcgtgttcgaaaagatcgaaatcttggaaggcgatggaggcgttggtactgctcttcgactcacattcccaatagggtcagtgccccttacttacaaggagaagtttgtgaccattaacgactggaaacgattgaaggaggtgaagcaaatcgaaggagggtaccttgatatgggctgcacattctacatggacagttttcatattttacgaaaaggtcctaagtcgtgtgtgattgtgtctaagactgagtacgaagtacctaataaggagatagcaagcaaagttgaaccttatatatctattgattcactcaggaagatggcaactgccatctcggattatgttctgaacagggcgaccaggaaggaagtgaagcacgaattagaggtggctgcctcggcagacgatgtgtgggagggctacaggtcacctgacgtgggcagcctaatttgcccacatgtgttcgaaaagatcgagcttgtagaaggtgatggcggtgttggcactattctgcagatcacgcatccaccaggatatgtgccacatacttacaaggagaagtacgtgacgctagatgatcacaaacgtttgttggaggtagagcaaatcgaaggaggataccttgagatgggctgcacattttacatggacagcattcacgttgtaaagaaaggtgacaactcatgtgtcatcgtgtccaaggcaaagtacgaagttcccaaggagttagcaagccaagttgaaccttacattgccgctgatgcagttgcaaacatggccagaataatctccaataatgttctagagaagaagaaatcatga

SEQ ID NO: 428 - DNA, 588 bp, Xanthoriza simplicissima
atgaggatggaagttgttctagttgttttcttactgttcataggtactgtaaattgtgaaagaatgatattcagtgggcgtcctctcctccatcgcgtaacaaatgaggagactgtaatcctttatcatgagctggaagtacctgcttcggtggatgaactgtggagtgtcgaaggttcgcctgagttgggcaagaatttgcctgacctgctccctggtatatttgcagacttcaaaattactggtgacggaggtgaaggttccatcctggatatgacattccccccaggtcagtttccacatcattacagggagaagttcgtgtttttcgatcacaagaatcattacaagttagtacaaatgatcgacggtgattttttcgatctaggtgttacatactatatggatacaatccgtgttgttgcaacaggccctgattcatgtgtcatcaagtcttcaacggaatatcatgtaaaagttgagtttgccaagatcgtcaaaccacttattgacactgtaccactagctataatgtctgaagcgattgcaaaggttgttcttgagaagaaatacaagagatcagagtaa

SEQ ID NO: 429 - DNA, 1419 bp, Argemone mexicana
tcttattattttcgtgtcattaccaaattcaagaaataacaagtaggaaatactttctttttcttttcggaaaacttcctaagggatcacaatttttatttaatgtcttttgagatatatacgtgtaacgtgacattctaatcaaaatactgattaattaaaataagtcaccaaaagacgatcaactcacgaaaatctttgccaaatattacaaataaaatggagagaattattaaatgagaaattattttttcttgaagagaatatgagtcatcatccattcttcaccattcttatacccaaacaactctgctccacacatgcagaaaattctccaaaaattaagcaatttttttgcttcttcctcactttttgttatagacttcattatttcttttacttcctcaatatttccatctattctcttcaaccattcttcatgagatcgagaataatgttttccgcttaaagtccattgatccacgacagcaacatcatcctgaaagtaaagaagtaatgtagcagatgataaggtcagagttccagcagggaagatgtagttagtgtaccaatcttcttcatcaagaggctcatagtggtaagctagggttttatggcaaacatgttcaatgaaaagaagcccatcttgtttcatccattctgatatcttcctaagtagtagttcatagttcttcatatgctcaattaattcaacagcgaaaatacgattgtatttttcctcggtttcataagttgtaatgtctgccaatataaccttgacatttgacagtttaagttccttgcatcttccttcaataaaatctttttgttcaacagaacttgtaataccagtaacataacaatttttgaatttttgagcaacatatagagttacagctcccaaaccacaccctaaatccagtacactttgaccatcttcaatttttgccctttttgtgtataaatccaacattgctatctcagcttcatccaacgttgtagattcatccttaaacaaaccagaactttctttaatggtgcttccatgttggatttgtacaaaggaaaatggtgcttcatacaattttaaatccaaattttccatttctgttgctattttcattttcttaagagaatgaactaagtgaaggagttgagaaagttgttgttcatgggtggatttataaccccaattaaggcgtttctctaattgaaccctaattaacttcctaatctcttcatctggaatcaaccctagttccatatttttcagtaaatcttctttcttaagttgttgttgattatttgcttctgccattaaacccatcttctctgcaaaaaataaacacaaagtctagagagagagagagatgtgagcactgatggataggttgtcagtaatatatatgaatataaaag

SEQ ID NO: 430 - DNA, 1568 bp, Argemone mexicana
tctctctctctctctctagaatttgtttagtttctctcactagatttagattgtgatttgtgtgtgttgatatggataattgtaaagtagaagggatgaagaaggagactagggcagctgaggagatacttgggagattattgaagggagaaattaaagatgaggagctgagaaaattaattaagtttcagtttcagaaaagacttgaatggggttataaatctactcatcaccaacaactctcttttaatcttgacttcattaagtccctgaaaaatatggatatgtcaggagagattgagacaatgaataaggaaacctatgaattaccaacagaattcttagaagcagcttttggaaaaaccatgaaacaaagtgggtgttactttaaacacgaatctacgacgatagacgaagctgaagaagcttcacatgaattatactgtgaaagggcacaaatcaaagatggtcaaaccgttcttgatatcggttgcggtcaaggaggtttagttctttatattgccgaaaaatataaaaaatgtcatgttacagggcttacaaattcaaaagcacaagtcaattacattgagatgcaagcaaagaagcttgggttatccaacgtcgatgttatattagcagatgttacgaaatatgactctgacaagacgtacgatcgactacttatgatcgaagccatagagcacatgaaaaacatacaactgtttatgaagaaactctcaacttggatgacaaaagacagtcttctctttgtggatcatatctgccataaaacatttagtcacccttttgaggcagtcgacgaagatgactggtactcgggtttcatcttccctcctggttgtgtgacaatactatcatctgatgctcttctctatttccaggatgatgtttcagttgtagatcattgggtcataaatggaatgcacatggctcgttcagtagaggcatggagaaagaaactagataagaatatgaaagctgctaaagagatattattacctggacttggaggaaaccatgaagcagtgaatcaaatagttactcacataagaacattctgcatgggaggttatgaacaattctcatacaacaatggtgaggaatggatggttgcacaaatgcttttcaagaagaaataattaattaatgaattcaaatttcttttacaaattttatttcttgtttttagttattctcttatatgtaataaatgacaatgtaattaagggttattttgtgtgtcactcccaaaaatatttcgtatttctgattcttttcttctcttgttttgaaaactttggagttacctcttctttcatgttcgataattgtaaaagatcccccctttttaaaaaaaatcggccggttcagcgagttgaaaagtccaaaatacccatttttttttataaataaaataaaaacaatcattctctaaatgttggatcttctaaaagatcaaacgactaggttcatcatcttcttcatttagactgaattgttttattttctttaaaaagggcattttagacttttcaatatgctgaact

SEQ ID NO: 431 - DNA, 1732 bp, Argemone mexicana
ctttggtctgaattctggagagagattagagagagagatggcattgaagaagataatggagatgccatacgcagctactgtacgtgtgatgttagcttcactcgaacgtaacttacttcctgatgctgtcattcgacaacttactcgtcttctcttatccactcgtttgcgactcggttacgctccctctgctcatcttcaactcgctcaacttcttcagttcgctcactctcttagagatatgcccatagccatcaagactgaggaccccaaagttcaacattatgaactgccgacctctttcttcaagtttgttctgggagagaatctcaaatacagttgttgctatttcaatgatacatcaagcaccttagacgatgctgagaaagcaatgttggaaacatactgtgaaagatcaggactagaagatggtcacactgttctcgatgttggatgtggctggggatccttatccattttcatagcaaagaaatatagcaaatgcaaaattactggaatatgcaattcaacgacccagaaggcgttcatcgaggagcgctgccgggatctcgatctccacaacgtggagatcattgttgcagatattagcatgtttgatatggaagcatcctatgaccgcatattttctatcgagatgtttgagcatatgaaaaactacaaggaacttctgaagatgatatcgcggtggatgaaacctgacagtcttctatttgttcatcatttctgccataaaacatttgcttaccactttgaggacataaatgaagatgactggatcactaggtacttcttttctggtggtaccatgccttcagcaaatctgcttctatattttcaggatgatgtttcagttgtcaaccattggcttgtgaatgggaaacattatgcacaaacaagtgaagagtggcttaaaagaatggacaagaacatgagttctgtaggccaataatggagtctacatatggcaaagattcatctgttaagtggactgtctactggcggacatttttcattgcagttgcagaattatttggatacagtaacggagaagaatggatggttgcacattttttatttaagagaaaataaatgattcgaataagaaaaaaggaggaaagaaacataatgccaggagttcgccaaagattctgtttcacatcctggccaaaatgagaatttgctaccttaacgaagactgaacctggtagaataataataaatcgtcagttgctgttatatctctaaatgatttagctgcatttttctatagagcttagtatggggcatgcagtttataggttgaacaacaagggtcgatgtccattgcactattgcaggcggccgtaggccatggacaatttaaataactatgttgatatattttattgttagctctgttatttaatactggaaaattacatacctttgtgagaaatcattgtattgtcaatattgtcggtggtttattatcatggtcactgtcatcaattgttaggttcaggtcatgttttttagggatgcataattatcttcatgctatggtgtttgttcatccatgcttgtacgtaagaatgtacgaaaagtgaagtatatgataaataatcaaaagctcatgttgcctctgttttgctgttctatatcgatgataatgggaagatagattattagtaaagtgctacttacagtttgtgtgtcggaccacttgagatac

SEQ ID NO: 432 - DNA, 1178 bp, Berberis thunbergii
gaaatataaaataaaaaaaaaacactgtttctctgataaacaaaggcaaagccatggaagttaagcaagcaggcaaagaaggtgttacagagttgttagtgaagaggatggagcttggtcttgttccagaagaggaaattagaaggttaatgaggattcagatacaaaaacgtctcgattggggttataaaccaactcatgaagaacaactagctcatctcaccaagttcatccagaatataagaggcatgaaaatggctgatgaaattgatgcgttagatgctaagatgtacgaaataccgcttcccttccttcaaactatatgcgggaaaaccttaaagttcagtccagggtatttcaaagatgaatcgacgaccttggatgaatctgaaactcttagatggatctatactgcgagagggcacaagtcaaagatggtcaaagcatccttgaccttgggtgtggccatggaggttttgttttacacctagcccaaaagtatagaaactctgtagttactggagtcaccaactcagtatctgaaacagagtacataaaggagcagtgcaagaagcttggtctgtcaaatgttgaaatcatcattgcagatgtaacaaaatttgaaccagaggttacttatgatcgcgtttttgcaattgcactcattgagcacatgaaaaattatgcattggttcttaacaagatatcaaaatgggtggcacaagatggatatcttttcgtagagcatcattgccataaagtattcccttacaaatatgagccactggatgaggatgattggtacactaactacattttcccgggtggaactttgattttaccatcagcctcaattcttttatacttccaggaagatgttacggttttaaatcattggagtctcagtggaaaacatccttcccgtggcttcattgagtggttgaagagattagatgagaacattgatgtcataatgggcatattcgagccattctatggtagtaaagaagaagcaacaaagtggattaattactggagagtcttttgcatgacacattcagagatgtatgcatacggcaatggtgaagaatggatgctttctcaagttcttctcaagagaaagtgacttctttcattttacataataattgtcttcttaataatgtttttacattttc

SEQ ID NO: 433 - DNA, 1269 bp, Berberis thunbergii
aagctgatattaacaaaaagctcaaagatccccactttggttttattctaatggactcaaaacaggcaaagaaggcatcagttgtagagttgttggagagattggaagaaggactagtttctgatgaagaactgaaaaaactggtgcatgttcaattggagaaacgtttgcaatggggatataagcctactcatcaagaacaactggcttttcatctggacttcataaaatcattgaaacaaatggatatcgctggagacatggagatgatgaattccgagtcatacgagttacctatttctttcctgaaaacaatgttcggaaagactcttaaacaaagtgcttgttattttgaatctgagtcagtaacaattgatgaggctgagatagcaatgaacgccttgcattgtgaacgagcgagattgaaagatgggcaaagaattcttgatattggatgtggtcaaggtagtcttatttttcatatagctaacaagtacaaaaactgccttctgactgggataaccaattcatgtacgcaaaagacttatatagaggagcaatgcaagaacttgaaactgtcaaacataaaggttatattagccgatgtaactaaatatgaaacagaggacaagttcgatcgaatagttattattgaagcccttgagcatatgaaaaatattgaactgtttctaaagaggacatccaaatggatgaaagaagatggtttactctttgtagatcatgtgtgccacaaagtattccctgataaatttgaggaacttgatgaggaggattggtactctgaatacatattccccaaaggttctgtaattgtcaatgctgcttcaactcttctatattttcaggatgatgtttcggtaatagaccactggataatcaacgggaagaacatggcccgttctcatgaagagtggatgaaaaacctggtgaaaaatgttgatgttgcgaaagacatactgaaagttgccatgggtagcgaggaagctgctgagagatgcattatccattgtcgaaactttcatctttccatgagtgaactcttctcttaccaaaatggggaagaatggatggtttcacacgtattgtttaagaagcgatgaacacctgtagatgctctaaggacctacaatttgtatccaataaaagaagaaatctatattacaattcagagtggtgttttactattcattgctgactgggacgaagtcaaatcgaaaggattagagataaaagatggttaggattgaa

SEQ ID NO: 434 - DNA, 1284 bp, Berberis thunbergii
tgaaccacaagggcattctcttcttctttcccttgtgagcatcaactcaacttttcttttgagtaatgggtggtgcactgattgaagtgagtgggcagaaattgagcaaggccgagttgttgaaaaacatcgaagaaggtttgattccggacgatgagttgaggagactcatgagaggtgaacttgcgaagcgcattcaatggggttacaaacctacccatgaacaacaagtagcccaagccatcaactttgctcattctctccggaaaatgaagattgcaaatgaggcggagacgcttgttgaggaagtgtatgagatgcccatgtcctttcttagactcatgcttggtccaactctaaaactaagttgcctctacttcaaaaatgaattcacgacgttggagcaagcggagatagatacgatggatatgtattgtaagagggccggaattcaggatggtatgagtattcttgatctggggtgtggtcaagggtcccttactctgcatatagctcataagtacaaaaattgccggattactgcccttaccaactcggcctcacagaaaggaaacattgaagatcagtgcaagctccagaatttgcctaatgtgaaggtgatactagctgacatagctaactttgacatggatgaaaccttcgaccgtgtgatggtgattgaactgttcgagcacatgaagaactatgcgctacttctcaagaagatggccaaatggatgtcctcggatgggcttcttttcgtcgatactctgtgccagaagacttttccttatcactttgatcccatcgatgaagatgactggtacacgaatttgctcttcacacctggtactagtatcttgccgtctgcttctttccttctctacttccaggatgatgtttcaattgcaaaccattggaccatcagtgggaagcatttttcgcgcactaatgaagagtggttgaagagaatagatggacaggttaatgaaataagggctgtgttgaagtcatttttgggcactgagaagggtgtggagaagttgattaactactggaggggattttgcttgtctgggatggaaatgtttgggtacgacaatggcgaagaatggatgaccgcgcattatctattcaggaagaagtgatcgtctcaacgacttcagcaaatggtctatattttaggtggtggtaaattttcttgttgaataataaagtgagaccgatgttgtaatcggtttggtcagtctgttttagaatgtggtctgtcttaatggagctatg

SEQ ID NO: 435 - DNA, 1476 bp, Corydalis chelanthifolia
ttagactgtaattttgcttcttaatcaatcaatcatctgtataattcttcgttttctttgatcattttttgaagttgattaatctaaaatggctacaagtgatcaagaggtaaaaacttcaaagatggaaatgattgcagatctgttgaagcgtttggaggcaggattagttccggatgatgagatcagaagtctgattcgagttgaattagagagacgtctcaaatggggttataaatctacacaccaagaacagctcgatcaactcctcaatttggctcactcaattaagaaaatgaaaattgcgtcgacagagatggatggcttgacttctacaatgtatgaggttccgatttccttagtgcaaatccaacttggtagccatctcaaagaaagttgtctttactttaaggatgaaacaacaacagtggatgaggctgagatagcaatgatggatttatacttggagagggcacaaataaaagatgggcagagcatccttgatcttggttgtgggctgggtgccgttagttttcacatcgctcaaaagtacacgagctgcaacatcactgcggtcaccaactcagtaagacagaaagagttcattgaggaaaagagcaagactcttaatgtaccaaatgttaaggttctcttagcagatataaccactctcgaaatggagcatacctttgatcgtctttttgctatcagtttaattgagcatatggaaaattatgaactactacttagaaagctatccgaatggatgaaacaagatggccttctctttattgagcatctctgtcacaaaaccttgtcctatcactttgagcccatggatgaagatgattggtatactaatctactctttccggctgggactttgactttagtatcagcctcatttcttctatacttccaggacgatctttcagtagtaaatcagtgggttatgagcggaaaacatttttctcgtgccaatgaggaatggttgaagaacatggatgcaaagatggacgaaatgagagaaatattcgagtccattacagacagcgaggaagaagttgtgaagttgattaaccactggagaatattctgcatcagctcggcggagatgttcgcctacaatgatggggaagaatggatgaattctcatgttctcttcaagaagaagaagcaaattcagtaatgcaagcgtgtttgaatgatgaatagtactggttagttgatctcaaacagccaaaagaatcgcttgttttataggtacactgtcttcttaatgtgtgttttctcacttctttttctttcaagttttccctaaaaatcacactttttagaattagcataatctattcaaggaagctgtgtgtaattcacaatttcatggacaaattaagggcgttcaaatttcgttgttaaatgcatttcttcatcgctaataaatatgttttgtaacaatagcaaattgtcgcaaaa

SEQ ID NO: 436 - DNA, 1557 bp, Corydalis_chelanthifolia
atctgattattgttatgcttattgtatgttattgcctaagtatttcttgtatgcataagcttaagtgaagataacagtcagtaagtacagtgttaaacgagaaacgagttcgatctctagtcttaaaaccaaaatggggccgcattatgtgcaaattacgatcaagaggtaaaaaatggctggaagtggtgcaaacaaggaaatgattgcagatttgttgaagcgtttggaagtaggattagttccggatgaagagattagaagtttgattcgatttcaattgaagagacgtctcaaatggggttacaaaactactcaccaagaacagctcgaacaactcctcagtttagctcactcaattaggaaaatgaaaatcgcgacagagatggatgccttgaattctactatgtacgaggttccaatttccttcatgcaaatcgtatttgggagcacccttaaagaaagttgtctttacttcaaggatgaagcaacaacagtgaatgaggctgagatagcaatgatggatttgtacttggagagggcacaaataaaagatgggcagagcatccttgatcttggttgtggaatgggatccctttgttttcacattgctcgaaagtacacaaactgcaacattactgcggtcactaactcagtaagccaaaaagagttcatcgaggaaaagagcaagactcttaatctaccaaatgttaaggttattttagctgatataaccactcttgaaatggatgatacctacgattgtcttttcgctatcggattaattgagcatatgaagaattatgagctactacttagaaagctatcaaactggatgaaacaagatagtctgctctttattgatcatgtttgtcacaaaaccttggcttatcactatgagcctatagatgaagatgattggtatactaatctactctttcctgctgggactttgactttagtatcagcctcatttcttctatacttccaggacgatctttcactcgtagatcattggagtatgagtggaaaacatttttctcgtaccaataaggaatggttgaagaacattgatggtaagatggacaaaataagagaaatagtcaagtcaattacagatagtgaggaagaagttgtgaagttgataaaccactggagaatgctctgcatcaactcctcggagatgttcggcttcaatgacggtgaagaatggatgaactctcatgttctcttcaagaagaagaaacaaatttagtaatacatggcatgttgaaaactttgaataatgaatactactggtttgattgatctcaaacacctaaaatatttgcttgttatatgtactttgtctttttaataaatgtgcgttctctaaccatctaagactagcttaaatggccatcggggcgttcttaataatgtaataatttctctcgcccttatgcaggtattcttaataatgtattttaagttgccttatgttttgagatgcttgctttacacatatctaagaacatcctttgttgttgtgcatgcacatggaaagtaaattccaat

SEQ ID NO: 437 - DNA, 1152 bp, Corydalis chelanthifolia
agtttattagcttttgatcaagaaatctaaaatcatggcattcagtgatcatcatcatgaagtagtgaaaaatcattcaaagaaggaaatgattgcggatttgttgaaacgtttggaggctggactagttccagatgaagagatgagaaatctgtttcgattcgaattggagagacgtctccaatggggttataaatctattcatcaagaacaattatctcaactgctcaagttggctcattccactaaggaaatgacaattgtggcggagatggatgccttgaattcttccatgtacgagcttcccatttccttcttgcaaatccaacttgggagcaacctcaaacaaagtagtctttacttcaaagatgaattaacaacggtggatgaggctgaggtagcaatcatggatttgtacttagagagagcacaaatagaagatggacaaagcatccttgatcttggttgtggacttggtgcatttagttttcacgttgctcgaaagtacacaaactgcaatattactgcagttaccaactcattaactcaaaaagagttcattgaaaaaaagagcaaaattcttaatatacaaaatgttaaggttatttttgcagatgtaaccacggttgaaatggaaactaccttcgaccgagttttcgccatcggattaattgagcatatgcagaactatgaactatttcttaagaagttatccaaatggatgaaacaagatggtcttctctttatagagcatttctgtcacaaaactttggcttatcactacaagcctattgatgaagatgattggtttactaatctactctatcctaatgggactgtaatctcgtcttcattacttctatactttcaggacgatgtttcggtagtagatcattggagtttgagtggaaaacatttttctcgtgccagtgaggaaagtttgaagaggatggatgcaaagatggacgaaatgaaagaaatattcgagtcaattacggatagtaaggaagaagctatgaagctgattaaccaatggagaatcttctgcattagttgtgcggagatgttcggttacaacaatggcgaggaatggatgacttctcattttctcttcaagaagaagctatgaagctgattaaccaatggagaatc

SEQ ID NO: 438 - DNA, 2106 bp, Corydalis chelanthifolia
ccataattccctttcctaatcttcttcaatcacaaaacaacaacaacacacactctccttctctctagaaacacaaacacacatagatagctagagagagaaatggctgtggaggaaggaggaattggtgctacaactgaaatcagtacaaagaaaccagaaattgctgagctattgaggaaactggaattgggtttgataccagatgaagagatcaggaggcttataaggattgaattagggagacgtctcaaatggggatacaaacctacctatgaacaacaactagctgaagtgcagaagttggctcactctcttagagatatgaatatcgcaaaggagatcgatacgttggatgagcagatgtatgaggttcctatttctttcttacagattatgtttgggagcacaatcaaaggaagctgttgttacttcaaggaggattcgatgacactagatgaggcagagatagcaatgttagatttatactgtgagcgagcgcagataaaagacggtgacagtgttcttgatcttgggtgcggacaaggagctcttacattacatgttgctaagaagttcaagaattcaagagtcactgcaattacaaattcagtttcacagaaagaattcattgaagaacaagccaggaaccttaatttgacgaatgttacagttacgttagctgatataacgaagcacgaaatggaagataggttcgatcggatattagttatcgaattgtttgagcacatgaagaattatgaactacttctacgcaaaatatcaaattggatgacgaaagatggatttcttttcattgaacatttgtgccacaaaacctttgcatacaactacgagcctattgatgaagacgactggtacacggaatacatcttcccagccggcacaatgattataccatctgcctcgtttttcctatatttccaggacgaccttacaattgcaaaccattggactcttagcgggaagcatttctcacgtaccaaggaggaatggttgaagagactagatgcaaataaagatgcagtgatggcaatcatggaggaattttcaggaagcaaagaagatgcagtgaaatggacaaattactggagaggattctgtttctctggaatggagatgtatggatacaacaatggtgaagaatggatggcttgtcatgttctgttcaagaaggactaattcagtttgttttacggaactatcgttaattttttaaagtatatcaataagatttgcagtaaaatctcaaatctctacaaactttcacctcaattatgaagtctgcaattgttgaatggagcactcatttgatgtattatgtcagaaaacacaatgtaggtttagggcaaagaagaaaagaacctcaaatgagcttcatatggttgaggaggtgtggacctaatgtatcgtataatcggtacacacctggaatcaacacttttgacatgagacatccttgttcaactcagaaagcgactagtacagagggtttttattcatagggatatagtttcagttgcaatcctaatgttttctttaatttcggattctagtggtattatggtgttcctcaatggttgtttttgtttaggtttttatgtaaaactgtgttgtgtgattacattctcgtttttttctttctctattctagttttgtaccttagtgatatgggtctaggtttccctaaaacagtacccaaaagagaactcttcgtagatatgatataatctctgaaaacacaaaatccagaaaggcagagaagaagtttcagatgtgtttcacattgaagcacattaatagttcaacacattttggcgttgaataatgaacgataatctatttacttttcagcagtgtccatcagcactcaacatttagattatggtgttagctccatggtctttcattgtcattcggttgtaactctaacttttatcttagattatactggtatggtgaggcttatcggttattcggttgtttcatgtaagacagttgttttatttgctttcttgttttctttattcttgtttcgtatcctagcaacacaggttgaggttttccctcacacaataacaaca

SEQ ID NO: 439 - DNA, 1434 bp, Corydalis chelanthifolia
attctttgtaaaaccgatatagagaaggcacatgatcatatggagtaggattttctatgtcatattcttaggaagatgcattggaggcatttggagagtttgagtttacaattgcatctctacgacttccttttacgttctaatcaactactcatcaaaagaaagaaatcctaatcaaacgcaaattatttaaactggtgcacttatttaagtccataaatcaaacttcgcagtttgtttctagcaatattacacccaaataaatgctgaatcaatttctctttttgaagagataatgtgaaatcatccattcttctccattgttatatgcaagcatttcagctccactgatacaaaagattctccaaaaattcatcaacttcactgcttcttctttgttaccatcacaaactgactcaaacatttgtttcactccatcaacattagcatctattcgcttcaaccattcctcttgagtacgtgcgtaatgatttccattgagagtccaccgatcaactacaataagatcatcctgaaagtagagaagaaatgaggctgatggtaatatcaaagtacccgggggaaagataaacatattgtaccaatcatcttcatcaacaggctcgcactgataagcaaatgttttgtggcagtaatgctccaagaaaagaagcccttcttttgtaatccacttagatatttttcgaagaaatagttcgaaattcttcatatgctcaattaatccgataataaatatgcggtcataagtagcatccatttcgagcatggtcacgtccgctagtatcatattaacgttcgacaaattaagctccttggatcgttgaacgatgaattgttgttgagaaatggagttggtaacaccagtaacattgcagttcttgtatttttgtgctatgtgtaacatgacagctccatgtccacatccaagatctaatattttctgtccatcttctattcttgctttctcgcaatataaatccaacatttttatctcagcctcatccaacgtcgttgattcatccttgaagaatcctgcactttctttaatggtggatccacacataagctgttggaatgcagttggagtttcatacatctgatcatctaaagtctccatctctgatgccattttcatacttcgaagagattttgcaaaatgaagaagttgagagagttgttgttcatgagttggtttataaccccatttcaaacgtttctctaaaccaatcttcatcaaatctctaatctcttcatcaggaatcaatcctaactccattctcttccaaagatctacaatttctttctttgggtttctagctgatgatgttgctactacttccatttttgatcaatgaaaataagaggctagctagccacagaacttcactgcagttggagttccatggaaaacag

SEQ ID NO: 440 - DNA, 1547 bp, Corydalis chelanthifolia
catcctcgggaaaacttcaaatgtcgttcatattgcaaaatatttacaaaaatttgcagcaaatcaaacataaccatagtattcgtataccctccaaggttaattacacaatatttattggattcatgatcaaaatatcacattgtggcaaatgatgctcaacaaagccactaaaatcaacaacaacaacaaaaaagaagaagtaaaaaacacctcaaaaaagcaaagaaaaaacacaaggcaaaaacatccatataactttccattgttcattcaatttgcttcttattcttgaagagaaaatgagaaatcatccattcttcgccatcattgtaaccaaacatctccgcgcagctgatgcagaagattctccattggttaatcgatctcgtagcttcttctttactctcagtaaccgactcgtatatttctcttattttgtccatattagcatctatcatcttcaaccattcctcggtggcacgagaaaaatgctttccactcaaactccaatgatccactacagagagatcgtcctgaaagtatagaagaaatgaagctgatgtcaaagtcccagtaggatagagtagattagaataccaatcatcttcatcaataggcttgtagtgataagccaaggttttgtgacagaggtgttcaataaagagaagaccatcttgtttcatccatttggatagctttctaagaaaaagttcatagttctccatatgctcaaccaacccaatggcgaaaagtcgatcgaaagtagtttctatttcgactgtggttacgtcggccaaaataaccttaacatttggtatattgagagtcttgcacttttcctcaatgaactctttttgtgttaatgagttggtaagtgctgtaatgttgcagctaatgtacttttgagcaatgtggaaaccaagaccacctagtccacaaccaagatcaaggatgctctgtccatcctgtatatctgccctctccaaatacaaatccatcatttctatctcagcctcatctagtgttgttgattcatccttgaagtaaaggcaactttgtttgagggtactcccaagcatcagcttcaagtatgggattggaacctcgtacattgcagaattcagggcatccatctccggcgcaattttagcaatccctttattcaattcaacgagattgaggagttgagagagttgttgttggtgagttgatttataaccccatttgagacgcttctctaattcaaatcgaaacatatttctcatctcttcatctggaactaatccacccaccaaacgcttcaacaaatctgcaatcactacctgcttattctttgaatcattttccattatcaccatctcatgatcacttgcagtactacttcccattaatgtttaattagcttagattgatttctaataatcttcaaaaaatagcaaagagaaggatgtatatgtagctggatgaaacttcaatgaatgactgactggttcatgaaagaggaattgcgtagcatttatttttatataaaacttcaatgaatg

SEQ ID NO: 441 - DNA, 1374 bp, Corydalis chelanthifolia
gttgaatgttattataggtgtcaagggtttaagacattgagtatgttcgagaaaatgtttcaactttcattttaattgatttgctcaataatgaactccggaaagtattacatttatatgtagacatttaccactatgtaaaatgtaaacatcgaaatgacacaatcttcaatagaaaaacactacaattatagatctctcttattgattagaactcatcacactgcgtttgatgtacaagtaaatcatttcttcttgaagagtatttgtgcaaccatccattcttctccattgttgaatgagaactgttcatatgctcccatgcagaaggtccttgaatgagtaataacttggtccactgcttctttgctgcctcccattgcaggttctagtatgcctctcacagtttccatgttgtcgtctagtttctttagccattcttgcactgaacgagccatgtgattcccgtttacaacccagtgatccacaaccgaaacatcgctctggaaataaagaagagcagaagacgatagaatcgtcacacatccctttgggaagatgtatcccgagtaccaatcttcctcatccattgcctcaaagtgatggttaaaagtcttgtggcagatgtgatccacaaagagaagactttcctctgtcatccaggttgatagtttcttcataaacagttcaatatttttcatgtgctctattgcttcaataagtatgattctatcaaatgttttctctgttttgaattcatgtttagtaacatctgctagaattgcctcaacgttcgtcaggtttagcttcttgctttgcatctcaatgtaattaacttgtgctcttgagttggtaaggcctgtaacatgacagttcttgtatttctgagcaatatagaggacaagacctccatgaccgcatccgatatcaagaactgtttgtccatctttgatttgtgctcgttcgcagtataactcatgtgatgcatcctctgcttcgtctattgtcattgattcatgtttaaagtaacaagcactttgcttaatggtctttccaaacatgctttctaggaattctgatggtagttcatatgattcattgttgaatgtatctatatctcctgacatcttcatctctttcaaagatttgacaaagtcaagattggatttgagttgatcctcatgggtggatctataaccccattgaagtcgtttctcccatatgatcctgatctgtttcttcagttcctcatctgaaacttctctctttcccaacctctccaagaagttgatacccattacttagattttcttttctcttctttctttgttcctttttcactctaacaagaaagaaccagagagagatagagat

SEQ ID NO: 442 - DNA, 1681 bp, Corydalis chelanthifolia
ttggtttatatttcctttcttttgattgattcaatcgatcacttcaatctcttttgcttgtctctctatttatgtttttctctttgaattgattgagatgcaaaagaaaagaagagatcgattgaatcaatcaaaagaaaggaaatataaaccaaccagctaagtaagtataagtaatatggctgtggtaaacatcttggaaagatttaggaaaagagaaattggtgatgaagagtttaagcaacacatcaggtccatatgggtaaaacgtcttcaatggggttacagatccacccatgaagaacaactcaattccaatctcgacttcatcaaatctctgaaaaagatggatatgtctggagatatagacaaatacaacactcaagaatatgaactaccatcagaattccaacaaatcatatttggtaaatccatcaaacaaagtggttgttacttcaaagaagaatcaaagacaaagacactagatgaagcaaccgatgattctcatgagttatactgcgaacgtgcacaaatcaaagatggacaaacagttcttgatattggatgtggtaacggaggtcttgtcctctacattgctcagaaatataagaactgccatgttacagggcttaccaattcaaaagcacaagtgaagcacattgagttgcaaaccaagaagcttaatttgacgaatgttgaagtaatactagcagatgtaactaaacatgtgttcaaaacagagaaaacatttgatcgtatcattcttatccaagtaatagagcacatgaaaaatattgaactgtttatgaggaagctatcaacctggatgacggaggaaagtcttctctttgtggatcatatctgccacaaaacatttaattaccattttgagccaatggatgagaatgattggtactcaggtcacatctttccagagggttgtgtgacgattttatcgtcttcttcacttctctatttccagaaggatgtttcagttttagatcactgggttgtaaacgggaagcacatggctcgttcagcgcaagagtggctaaagtcactagatgataacatggaaaaagtgagagagatacttgaaccatcaatggggggaaacaaagaagcagtggatcaagtacttactcaatcaaggttcttctgcatgggagcatatgagcaattctcaaacaacaatggagaagaatggatgtttgcacagctactcttcaagaagaaataaaatgaatgcagctgcagctgcagctagctagatagctactatgcttgatcatgatcgatcagtaataaagtttcatcttatgtactgtatgtattatcgaaattaagatggttgtgttgtgttgtgttgttgtttacgcatacctgagtgagcgtagcaagtagaagttatcaataattatgaatcaataatgctctggcctcctctcaaaaaaaataaaaataaaataaaataatgctctggcgggctctgagtcttttgacggaccaatcttgaatttttaatgttgaagagagacagttgaattttgattctttgaatgttgttgaagagaggcaaagagttgaattttgattctttgaatgctgaacaagtgtgacgagtcaaggagagccagtcttgtttgtttaatttattgaataaaaaacaataaacagtatt

SEQ ID NO: 443 - DNA, 1378 bp, Corydalis chelanthifolia
ctctctctctctctctctctctcatggagatggaaaagggatcatcttcaggtgtgaagatcctagagaggttgaaaaagggagaaatttctgatgaggagctaaagaagcatattagagttcactgggagaagcgtcttcaatggggttacaagcccacctttcaagagcaactccaatccaatctcgactttgtcaaatctttaaaagaaatggaaatgtctggagaggtagaaataccacttaatatcggcgagtcggatgaggtatccaactatcaaaagaagaggaaatcatatgaactatcatcagaatatttgggagccatgtttggaaagacattgaaacaaagtgcatgttactttaaggatgaatcaatgacactagatgaagcggaggaagctgcgtacgaactatactgtgaacgagctcaaattaaggatggtcaaacagttattgatattggttgcggccatggaggtcttgttctttacattgctcagaaatacaagacttgccatgttacaggccttaccaattcaaaaacacatgtgaattacattgagatgcaatgcaagaagcttcagttgtcaaatgttgatgtaatattagctgatgttacgaaatatgataccgagaaaacttttgatcgaatagtcgttgtcggaacaatagagcacatgaaaaacatcggtctctttatgaagaagttatcaacctggatgaaaaaagaaggtcttctttttgtggatcatacttgccatacatcatttaattaccatttcgaggcaatggacgaggatgattggtattcgggttacattttcccgaaagggagtgtgacctttctatcgtcgtctgctcttctctatttccaggaggatgtttcggttgtggatcattggcttttaagtggaatgcatatggctcgttctatgcaggagtggatgaagaaaattgaacagaacatggatacattgagatctctattagaacaaacaatggaaggggggagcaatgaagcagtgaaccaagttgtgactcatttgaggaccttctgcataggagcctatgagactttctcatacaacaatggagaagaactgatgatggcacagttcctcttcaagaaaaagtagtgatcatcatttagtagtacttgtaagattttacttgttgtatatgggttctctcaacaccctattagggccagaagagtttcaaacagagtatattcgtcgcataaaacatcgaatgcgaataatacatatgtatattgagaaaggatcaaaagccccacttaaaagcgccacgaaaaccccatttcaacatttaagcaatcaaagttcaaaccgctcaaattttgtggagatgtttt

SEQ ID NO: 444 - DNA, 1684 bp, Corydalis chelanthifolia
caatccaagctttccccaggcaacctcagacactgaattaccagttttcaggttttgccagatattacgagcgagggtctctgttttgtgagtccaggaattgaaaatgtcgactactgattccatgggactgttgctgggtttttcaataggggaatgttgaacatagggatggtgatcttcagcactccacagagctgctttctgattgtttgggtgtgaagctggtacaccaggaggacccatgatatgggttccccatttctctgcatcagcagcagctactttctcactattgaaaggcagctgagctggatcagaaggtaaagaagaagaagggggtgatggttgttgctgctgctgctgcatgagttaacttggtgttcaccgactggccggagagaaaagagaaatggaaagattgtttcaacttccatacgatgctaccgtgcgcatgatgttgaatgcactggagaggaacttgttaccggacttggtgataagaaaactgacgcggttactgttaggtagtcgtctccggtggggatacaaatctatatcagatctccagctctctcatctcctccaatttgcacactcacttgaagaaatgccaatagccatcaagactgatgcagctaaaacccaacattatgaattacccacctccttcttcaagctggttcttggcaaaaacatgaaatacagctgttgtcagtttgataaatcaaacaccaccttggaagatgcagagatagcaatgctagaactttactgtgagagagcacaaataaaagatggtcacactgttcttgacattggatgtggctggggatctctttctctattcattgcaaagaaatatagtaagtgcaaaatcacagggatttgcaactcaactacacaaaaaacccacattcaagatcaatgcagagacatgaacctgcagaatgtggagattattgtagcagatatcagtacatttgacatggaatccacctacgatcgactcgtatcgatagaaatgtttgagcatatgaagaactacaaagagcttctaaagaagatatccaaatggatgaaacaagatagtctcttctttgttcatcatttctgccacaaaacttttgcttatcactttgaggacacaaatgaagatgactggattactaggtacttcttcactggtggaactatgccttctgcaaatctacttctctacttccaggaagatgtttcagttgtcaaccattggcttgtaaatggaaaacattatgcacttacaagtgaagagtggcttaaaagaatggacaaaaacttggattctataaagccgataatggaatcaacttacggaaaggattcagctgtgaaatggactgtgtattggcgtacgttcttcatatctgtggcagagctatttggatataacaatggagacgaatggatggttgcacatcttctgttcaagaagaagtaaatacatgcaacaaaatctatgaagaaatccttaccaattgttgttttagttaataaatagaataattggatttcacctccctgagttctttttcaattcaagcttacatcccttcgatcttgataaaagaattctccgcttcctccatcataaatgttaactgagctgaatcggtattttttttggaccgttatgttcttatgc

SEQ ID NO: 445 - DNA, 1356 bp, Chelidonium majus
tttggtcttgtcttccgagaaatccacttagtttcctcactagcctatagactgtatcattatgggttcaatagatgaagtgaagaaggaatcagcaggggaaacactagggagattgttgaaaggagagattaaagatgaggaactcaagaagctgattaagtttcaattcgaaaaacgtctgcaatggggttataaatcatctcatcaagaacaactctccttcaaccttgacttcattaaatccttgaaaaagatggaaatgtcaggagagattgagacaatgaacaaggaaacctatgaattaccgtctgaattcttagaggcagtttttggaaaaactgtcaagcaaagtatgtgttacttcaaacatgaatcagcaacaatagacgaagcagaagaagctgcacatgaattatactgcgaacgagcacaaatcaaagatggacaaactgttcttgacattggttgtggtcaaggtggtctagttctatacatcgctcagaaatataagaactgtcatgttacagggctcactaattcaaaggcacaagtcaattacttactcaagcaagcagagaagcttgggttgacaaacgtcgacgccatactagcagatgttactcagtatgaatctgacaagacatacgatcgtctacttatgattgaagccatagagcacatgaaaaatttacagctgttcatgaagaaactatcaacttggatgacaaaagaaagtcttctctttgtggaccatatctgccacaaaacatttgctcacttttttgaggccgtcgacgaggatgactggtactctggtttcatcttcccccctggttgtgcaacgatactagctgctaatagtctcctctatttccaggatgatgtttcagttgtggatcattgggttgtcaacggaatgcacatggctcgttcagtagacatttggagaaaggcgctagacaaaaatatggaagctgcaaaagaaattctattacctggacttggaggaagccacgaagcagtgaatggagtcgttactcacattagaacattctgtatgggaggctatgaacaattctcaatgaacaatggagatgagtggatggttgcgcagctacttttcaagaagaagtagtgaagcaatttccatgccaattgagttttccagagctgtgtgataatgtgattttctagtaacaatagttgtgggttgtattacagcggtttggcttgtttttattgtctgcatttctacttcgctttttctttttgttcggattcaatatttgaagaactcctttcttaactatatcatgtaacggatttgtcaaatcaacaatcgtgagaaaattg

SEQ ID NO: 446 - DNA, 1273 bp, Chelidonium majus
attaaataaaagttgcaaccaatcattctaaacagtttttattacgatgatatggcataattatgatgttaaacaacacacacaaaacgaaagcataaaacaaattttctcattttttcttgaagagaagatgggtcagcatccattcttcaccattcttgtaaccaaacaactccgctccacacatgcaaaaaatcctccaaaaattgagcaatctgttcgcttcttcctcagttttagttatagacctcattatttctttgaattcaacgatgtttttatccatgtttttcaaccattcttcatgggatctagaataatgctttccactcagagtccattgattcacaacagcaacatcatcttgaaagtaaagaagcattgaagcagacgatagagtcagggttccagcagggaatacgtagttagtgtaccaatcttctgcatcaacaggctcataatggtaagctagagtcttatggcaaacatgttccacgaaaagaagtccatcatctttcatccattctgatattttcttaagaagcaattgatagttcttcatatgctcaatcaattcaactgcgaaaatccgatcaaatctttcttcagtttcgtaagttgttatatcagctaataaaaccttgacgttggtcaacttaagctccttgcattttccttgaatgtaatctttttgttccacagaacttgtaactccagtaaattgacatttcttaaatttgtttgccccgaaaagagctacagcacccaatccacaccctaaatcaagtacactctgaccatctttgatctgtgccctctccatatacaaatccagcatcgctatctcagcttcgtccaacgttgttgattcatcagtgtagtaaccagcactttgtttcatgttgcttccatgttggatctttaagaattccataggtgcttcgtatagttttaaatccaaattctccatctcagttgccattttcatacctttcagagagtgaaccaagtcaagaagctgagaaagctgttcttcatgggtttctttgtaaccccattggagacgcttttctaattcgactctaatcagttgtctaatctcttggtccggtatcaacccaagctccatgttctgcaacagctcttcctttgccattaactgcatcttcttcaacttgcaaagaaaaacacacaacaaagtctgttgatcttccagtgaagttcagacagagagtcagaggtagtggatacggagttggattagttggtaatc

SEQ ID NO: 447 - DNA, 1245 bp, Chelidonium majus
gagaacataacattttcttacttttagttcctctaatccacacccccaaaagaaaagttgctcaagttgaacttaaaactgtagaattcttattcaaggacttcataacaatgccatttaaagaaagaaatagaaaagctgaatcatttcttgaacagaacatgagaagccatccattcttcaccattgttatatccatacatttccattccagataagcagaatcctctccaatagttagtccatttcaccgcaccttctttggtgcctgaaaatgactccattatcttcattacttcatctacattggcatctaacctcttcagccattgctccttggtacgggcaaaatgctttccgcttagcgtccactggttcacaaccgataggtcgtcctggaagtacaagaaaaaggaggcagatggtatgatcattgtcccagctgggaagatgtactcggtgtaccaatcatcttcgtcgataggctcatagtgataagcaaaggttttgtggcatatgtgctctatgaaaagaagcccatcgttcgacatccatttcgatattttacgaagaagtagctcgtagttcttcatgtgctcgaacaattcgataaccaatattcgatcgaatgtatcctccatttcatgtgtggttatgtctgctaacataacctcaacattctttagattaagcttccttgatttctcctcaatgaattctttctgtgacaccgagtttgtaactgctgtaactctgcaatttttgtacttgttggcaacatgtagagtaagagctccctggccacacccaagatcaagaacactctgcccatcttgtatttgcgccctctcgcagtacaagtctagcattgcgatttcagcctcgtctagtgtcgtagactcatctttaaagtaacagcagcttcctttgatggtgcttccaaacataagctgtaggaagggaattggaacttcatacatctgttcatccaacgtatcgatctccgtcgctatgttcatgctacgtagagatcgagctaatttgacgacttgagcaagttgttcctcatatgtgggtttgtaaccccattggagacgcctacccaattcaatcctcattaaacgtctgatctcatcatatggaaggagcccaagttccaatttcctcaacagctctgcaacttctgccttctttgcatttgatgactctgtaatttccacacccattattctagagagagaaaag

SEQ ID NO: 448 - DNA, 1499 bp, Chelidonium majus
ttcaccccaactttctctttgttttcagaattattggtacatccaacttattcttacactctgttaacacttaactttcgaccaccttaacaaaattctagaaatatgtgtattctttgtaacgataatgtgtggtgaagtgattattctcatgtagagatgatccaaaggttagatttttgttttcttccacaagatacgtggaacaaaatttattattattcagagttacaatagagaaaattaacaccttattcttagtttgatttaggatggcataaaacgataaaatgcttacaatagggatcaaatttattttttcttgaatagaacttgtgaaatcatccattcttcgccatccttgtacccgaacatctctgcagcactgatgctcaagaatctccaaagtctaattagtttcataatgtcatcatccttagtttcggacgctgctgctttatatatttctttaacttcatcaatcttattatccattctcttcaaccattcttcattggaacgagaaaaatgttttccactcagagtccagtgattcacaactgaaacatcatcctgaaagtatagaagaaaggatgatggtataaaagtcaaggttccagctgggaagaaatacgccgtataccaatcatcttcatcaataggctcattatgataacccaaggttttgtgacagagatgttctataaagagaaggccgtcttgtttcatccaggcagagaacttcctaagaagtagttcataattcttcatatgctcaatcaatccgatagcgaaaatgcggtcaaatgtggcctccatttctagggtgcatatgtctgttaaaataaccttcacatttgacacattaagaattttgcacttttcttctatgaattctttctgtttgactgagttggtaactgatgtaacattgcagttggtgtacttttgcgcgatatgaaaagcaagcgcacccaatccgcaaccgagatcaaggatgatttggccatcttttatttgtgccctctccaagtataagtccatcattgctatctcagcctcatctactgtcgttgattcatctttaaaatataagcagctctccttcaaggtgctcccaagctgtatttcaagaaaggaatttggcacttcatacattgtcgaattcaacgtatcaatttttgttgctatttccatttgcttagtagcgtgagccaagttgagtagttcagctagttgctgttcatgagtaggtttataaccccatttgagacgcctttctaattcaaatctgatcaccctcctcagctcctcatctgaaaccaatcctgaatccaaacgcttcaacaaatctacaacctttcccgaagccattaaatattttgagcagagaaatttgattacagattaaaaacaacccaacaattagaatatataaacagatcgattccaatgccagtcttcaaatgttatcgttcataataggccaaggcctttct

SEQ ID NO: 449 - DNA, 1193 bp, Chelidonium majus
actatggaaactggtaagaataatcaaaacatgaagacaacaattgatgatctttggaaccaaatgatgctgggaattgtccctgacaaagagattagaaggttgatgaagattgagttgaaaaagcgtctggattggggttatagacctactcatcaacaacaactttctcaacttctagatttcgccaagggactttgcaattattgttggacagctcttcgatgtatgaagatgtcagcggagtttgatactttggattccaaggtgtacgagacgccaaagtcattccaacaaattatgtgtggaaccaccatcaaggaaagttcaggtctgtttatgaatgaatcgacgacgctagaccaagctcaaataagtatgttggatttatatttcgacaaggcgaaaataaaagatggacaaagcatattggatcttggatgtggacatggagccctcatcttatacttggcacaaaaatatcagaactgcaacattacgggtgttaccaattctctgtcgcagaaagagttcatcgtcgagaaatgcaagaagcttggtttatcaaatgtcgaaattttattagcagatgtaacaaaattagaaatggaagatatgtttgaccgcgtatttgttatcggactgattgagcatatgaagaacttcgaactgtttcttcgaaagatatcagaatggatgaaaccagatgggcttcttttcttggagcattactgtcacaaaagctttgctcatcagtgggagcctattgatgaagaagattggttcagtaagtatatctttccacctgggacagtcataataccatcagcctcttttcttctatattttcaggaggacgtgaaggttatagatcattggactcttagcgggaatcattttgcacgtactcaagaagagtggttgaagggaatagatggtcacattgatgaagtagaaaaaacatttgagtcattttatggaattagcaaagaagaggctgtcaagttaattaacttctggagagttttctgcctgtctggagttgaaatgtttggatacaacaatggtgaagaatggatgatatcacatcttctttttaagaaaaagtaatttttaataaaaactgcttattgatttgttcaaattttaatgacttacatcaatgtatgtagaattacaaaaattgagaataa

SEQ ID NO: 450 - DNA, 1134 bp, Chelidonium majus
gttttaatttgagaatcagatatgggttctagtgaagcaccatcagttattggatcgtcaaaggcaggggagatcatggggaggctgatgaagggggaaattggtgatgaagagcttagtaagctcgttaggcatcaatgggagaggcgtcttcaatggggttacaaacccactcatgaacaacaacttgcttgcaacttcgatttcatcaaatccctcaaggatatggacatgtctggagaaattgatacaatgaatgaagagacctacgaattaccaagtgctttcttagaagcaactttcggaaagaccatcaaacaaagtggatgttacttcaaagacgaaacgactacattggatgaagcagaggaagcttctcatgagttatactgcgaacgagcacaaatcaaagacgggcaaaccattctagatattggttgtggtcaaggaggtcttgttctctatattgctcagaaatataagaactgccatgttacagggcttactaattcgaaggcacaaatgaattacattttgatgcaagcaaaaaagcttcaattgtcgaatgtcgatgttatatcagcagatgttactaaatttgacaatgataagacttatgatcggatactagttattgaggccatagagcacatgaagaacattcaactatttctgaagaaattatcaacctggatgaaaaaggacagtcttctatttgtggatcacatcagtcacaaaaaatttaatcaccactttgaggcactcgacgaggaagactggtactcaggtttcattttcccgaaggggtgtgttacaattctttcatcttctactcttctctatttccaggatgatgtttcagttgtggatcattgggtcgtaaacggaatgcacatggctcgttcaatggaagagtggagaaagaagctagacaaaaatatggaagctgcaagagagatactagaacctgggcttggtagcaaagaagcagtgaaccaagtgatcacacacataaggacattctgcttgggaggatatgaacaattctcattcaataatggagaggaatggatgattacacaaatgctcttcaagaagaagtgatatgcaaattcaacaactacatttccaaga

SEQ ID NO: 451 - DNA, 1053 bp, Cissampelos mucronata
tgatctctctacgtaaattgaacattgcaactgctgtggatacattggactcagagatgtatgaggtgcccatctcctttttaaagatcatgtttggaaacacaatcaaaggaagctgttgctacttcaaagatgattcagtgacattagatgaggcagagatagcaatgttggatctctactgtgagagatcacagatcaaagacggccaaagagttctcgatctcggttgcggacaaggagctctaacaatgcacgtcgctcgcaagttcaggaactgtcatgttacaggaattaccaactcagtgtctcagaaagaatacattgaagagcagtgcaaaatcaacaacttgatgaatgtggaaattaaactagcagacataacgacgcatgaaatggaagatagatacgaccgcattctagtcatcgaattgattgagcacatgaagaactacgagttgcttcttcgaaagatatcggaatggttgacaccagatgggcttcttttcattgagcatatatgccacaaaacatttccctaccactatgagccgctcgatgaagatgattggtttacagaatacattttccctgctgggactatgatcataccatcagccaactttcttctatattttcaggatgatgttacggttgtgaaccactggactcttagcggaaaacattactcgcgtacccacgagtcgtggctgaagaacatagatgccaatgcagaggcagtgaagaaaataatggtatcgttcacaggcagcgaggatgctgcattgaagcagatgaactactggagaggattcaacttatcaggaatggaactctacaagtatagaaatggagaagaatggatggcctctcatgttctattcaagaaaaagtgatgatgatgatgatatatagatgcatatatgcaaacctagctacaacctagtcataataattgtggaactcaaatgaggagctattaatcttaaagtcgatcaccggttacctcgaaaaggagctattaatcttaagtcgatcaccggttacctcgaa

SEQ ID NO: 452 - DNA, 2266 bp, Cissampelos mucronata
cgggatcagcgacatttttccctcagggaaatacttcagattgaactgctgagtgaactccaaccatgtatgaggaacttctctagtgactactagattgcgccaccagtcatcggcttcatcataaaggcactcagaggaaatagcagccttcatatgctcaggtgtattgatcaccatgtatatcttctcatggttcttgagaaacatctctgctgctactaaatcagtacccccataatactgtgcaggcttcctcctctgaaactccttcgactgcttagcctccgcagtcgctttaccacttctctctgtagtcggactggaactgtggccaccggtaatgacacagtagtaggaagtataggtgcagcctccacctgactctcttgaactattggcactgtagaggtagatggtgatggtgctccaggtgtctacgctcttaaaagtgcgagaatctcatccaacctggcatcctgtgacgtgactctgccggctaaagcacggacctcatcggccgtggtacggacttcctgggccgtagcatatcgcggctccgatgtcatcaccaggcgtaggaagatcggccatcgtaataaggatgtgcaccagctcctaagtctcaaaagaagtcgtcgatcacctccttgcctttactaaccgagacggaatctaacttgcttgatcccaaaacaagctttaaatcatctttttcctccacttgcttgaagccctaggagagcaccatgagaggccaagagaatgcttggacggctagagagagagagagagagagcaaaaagtggaagcaaagaaaaacatagaagaagcgatggccgcgggaggaggagaagaattcggtgatcgggtggaacagaagcttaataagaagggagaggtggcggagcttttgaggaagttggagttgggggagcttcctgatgatgagatccgacggctaataaagctccattggataggcgtatccgatggggctacaagccctcccacgagcagcaagtcgcctatctcctcgacttcgccaactctctacgtaaattgaacattgctactgcggtggatgcattggactcggagatgtatgaggtgccaataccctttttcaagttcatgtttggaagtacagtcaaagcaagttgttgctacttcaaagatgatttcgtgacattagatgaagctgcgatagcaatgctggatctgtattgtgagagatcacagatagaagacggccaacgagttctcgatgttggttgtggcgtaggagctctcaccatgcacgtagctcgcaagtataagaactgccatgttaccggagtaaccaactcagtggctcagaaagactacattgaagagcagtgcaagatcaacagcttgacgaatgttgaaatcaagctagtagatataagtagtcatgaaatggaagagaaatatgaccgaatactagccattgcgttcattgagcacatgaagaattatgaattgcttcttcgaaagatttcgaaatggctggcaccagaagggcttctttttattgaccatgtatgccagaaaacctttccttaccactatgagcctatcgacgaagaagattggtacacagaatacatttttcctgcagggactatgatcataccatctgccaatctcttactatattttcaggatgatgttacaattacgaaccattgggttctaagtggaaaacatttttcgcgtactcacgagatgtggctgaagaacttgtatgccaatgcaaaggcaatgaaagaaataatggtgtcatttacaggcagcgaggaggctgcagctaagcagatgaactactggaggggattcgccttgtcaggaatggagctcttcgggtatgaaaatggtgaagaatggatggcatcacaccttctctttaagaagaaatgatatatatataagtctagctctgtctagctctctaataagtgtggcttcgaaaaaaaaaataagtgtggttaaatttatgacgagttcattggacttgcctcgattttcgcaccacgagattagattaattatagtgctattgttgggagcatctcaatggtgtacttatttaagttttatgtaatgttaagtccaatccaagatgagagtgtgtcgctagtatgtaaactaaatgtgaagataattaagttggagaacatatactccacaatcatgagtcattattattttttaagtagtccatatatgagatactatttattcc

SEQ ID NO: 453 - DNA, 1305 bp, Cissampelos mucronata
tgttagaatcaacttataaaaaataaaaaagctaattttaaatttctcttaaattcacgacatattaaataattattattgtagttgagatacattgcaattattttcccttccaagttgcagtcatgaacctatttaacccttgtacgtatcattttttcttaaataaaacatgagatgacatccattcttcaccgttgttaaatttgcatagctcaatcccatacaaacaaaatgttctccaatagttcagcatcttcattgcctcttccttgctccctattgagccctccaaaatagctcttgcaacatttgcattaccatccaatctcttcaaccattcttcgtttgtccgcgaataatgctttccattaaccatccaatggttcacaacgtaaacatcatcctgaaaataaagaaggagattagcagaaggtatagtcataacccctcctggaaagatatattcttcaatccaatcctctgcaccaagaggctcaaagtggtacgcaaatgccttgtggcatatgtgatcgacaaagagtagtccgtcttgcttcatccacttcgatattttccttaaaagtagtttgtagttcttcatatgctcaatcacgccaatggccatgattcgatcgaattctctgtccatttcatgagtggttacatctgctaatataacctccacattgaccaaattatctttcttgcactggtcttcaatgaactccttttggaaagttgaattggtaactccagtaacttggcaattgggatatttgcgtgcaatataagtggaaagcgcgccaaatccacatccaagatcaagcactcggtcgccatctcttatctgcgacctctcgcaatatagctcaagcattgctatctcggcctcatctaatgttgtcgaatcgttgatgaagtaacaccaactcgctttcattgagcttccatgcaagagcttcatgaaagagttgggaatctcatatacttgtgactccattgcttccgcctccaacgaaatcggcatttgtttcagtgaatgggcaaagtggacaacttgagcaagttgttgttcgaatgtaggtttgtacccccattgaagtcgcctctgcacttggaccctcatgagatttctgatctcttcatcaggaattagaccaagtcctaatttcctcagcaactctgcaacttctccccggttagacagcgggcgcttcgccattaaaaccgcccatgtttgccatgccttcagaggaaacccacttgaaatcgctcctacgtctctctctctctctctctctc

SEQ ID NO: 454 - DNA, 1253 bp, Cissampelos mucronata
attagcagcctgtacaagtccggtttagttacttgtttttggtgtttgttgttagctatggaggtaaagcagagcaagggagacgagttgaggagcagagttgcagagctgttggagaggccagagcttgggcttgtaccagatgaagagatcagaagactcgctaaggctcgactcgaaaagcgtctcaaatgggggtacaaggccacccatggagaacaactctcaagccttcttcaatttgttgaatctcttccatcattaaacatggcaagtgaggatgactccccaaaagcttggctttatgagacaccaacttcattccttcagcttatctatggagacatcatcaaagaaagtgggtcatactacaaggatgaatcaaccaccttagaagaagctatgattcataacatgaatttgtgttgtgaaagggcaaacataaaagagggacaaagtgttgttgatcttggttgtggctatggagcatttattcttcatgttgcacaaaagtacaagacttgtagagttactggcatcactagctcaatctctcaaaaacattatatcatggaacaatgcaagaagctgaatttatccaatgttgaagtcatactagcagatgtagcaacaatcaaactagacgccacatttgaccgagtatttgctgctggaatgtttgagcatgtaaatgactacaagtcatttcttagaaaaattactaactggatgaagcccgatggccgcctctttgtcgaacatctctgcaacaaaacctttccatatcaaaataaaccacttgatgatggtgacaattggggcgagtacgttttcccatctggggggctgattataccttctgcttcacttttgctttacttccaggaagatgtttcaattgtaaaccattggacctttagcggaaagcacgcagcaaataaatttgaggagttgttgaagagaatagatgccaaaattgatgctataaaaaggatattcaacgagtgctatggaagcaaagattcaataaggtttatcaactactggagagtattccttattacagcggcagagatgtttggatacaacaatggtgaagagtggatgggcgttcatcttctcttcaagaaaaagtgaagatatttttagtgttttttttaaggttaaatggagtatataattgggatgttgagtgtgtaatccctctctcgtaaaataattaaatgatgagagtttaaaacgaaataagcggg

SEQ ID NO: 455 - DNA, 1718 bp, Cissampelos mucronata
aaaatttctggatactcacggttttcccaaccattaaaaataataataataaaacaagagaccttaggtttaggtttattcactagacaccagtaaggatgaaccgtcttccaagtttgaggcttgcttcacccctaaatagggttacatctccggctacagcaccatttgaagtccttgacaggacattgttggtgtcattttatttaatacatatatatacgggaaaatataatctggtaattttaaagcatataataagttaaaagcatgcgagatgatcacttcttcttgaagagaagttgagagcacatccactcttcaccatcattgtatgcaaacatctcggcagcagtaatgaagaatactctccagtagtttataaacttgattgctttttctttgcttccataaaactcagtgaacatgtcctttattgtgtcaatgtttgcatcggttctctccaacatcttctcaaagctacgtgccccatgcttcccattgtaagtccagtgatacacaacagaaagatcatcctgaaaatataaaagaagggaagcggatggtacaatcaaacccccagatggaaaaatgtattcctcgtaccaatcttgatcgtcaattagcttattttggtatgcaagggttttgtggcacaaatgttcaacaaagaagaggccatcaggtttcatccaattagagattttccttaggattaacttatagtcatttatctcctcaaacattccaaaagcaaagactcgatcgaatgctgtgcccaattcaattgttgccacatccgctagtatgaccttaacattacacaaattgagctttttgcattcttccatgatatgatgtttttgtgtgattgaacaagtgatgccagtgacactacaggacttgtacttttgtgcaacatgtagaacaaatgctccgtagccacaaccaaggtcaataacattctgtccctcttttatgtttgccctctcacagcacaaatccatgttatgtatcatagattcttcaaacgtggaagattcatgtttgtagtaataaccgctgaatttaatgacgttcccaaagagaagctgaaggaaggaagttggtgtctcatacaaccaagcttttgaggactcatcctcacttgccatatttagtgatggtagagactgaagaaattgaagtaggtgagagagttgttgttcatgggtgggtttgtaaccccatttgagacgttttgcaagctgtgccttagcgagtcttctaatctcttcatcttcaaaccctggtctctcttcttgttctccaatgttaacgcggttcttcaactcttcatcaatattgttgttgctctcatgctgcttagcctccatagcttagtaattacctgtattagtcaagcaaattaatcagcgctatttaaagagtaacaactgacctgcgatttgatgcgtgaactctagatctaactagaagaacatttttttattttttattttttttttgccctccttcgaaaggttgttgtccccctacatagggttgttgtctcccttgagaggttgttgccatttttgtgggattgttgctaagaatgttatagggttttaaagaattgtcttttctattatcgtcatgtaatatatttttatacctatttgaatggttaggaacaataataaaacaaaattaaggaagaagaagaagaaagataa

SEQ ID NO: 456 - DNA, 1583 bp, Cissampelos mucronata
cttttttattatttccttaattaatagtcaaaaacaaaagagagcgtccactaactgtagcaaacgtagcgcagttgccggcataatatgaaactctctttcgaaaacacttgaaaaattcagtgaatgaatagttgtacgcactgcaagccaaaccttttgctagtgtttcaaactcttcgaagagtttggagacactgtcatcatttatcataagtctgctagctagctaagtaattaatttttacagtattaattgttcgacaacgatgaccttttgccttccttagtttggactttttcaacaacgtaccttcaaattaatccttcatttctaatacaccatacttaatagcatgtaatgagtgcatttattcgaagatgcgtaattaattccacataacgagaagtactcaaaagtggaattatttcttcttaaatagaaaatgggctatcatccattcttcgccattattgaattcgccttgcattattccatgtatgaaagacaacctaaactggttaatccacttcacagcttcatcctcactgcccaaaaagtccttcagaactgcttttgcagcattagcattgtcatctagtctattcagccaagcttcacttgagcgggaaatatgcttgccattaaggacccaatgatttgcaattgaaacatttttctggaaatacaatagcaagtctgcagatgcgatggtcacaatctcatctggaaagattatttcttcaatccaatcatcttcgtgtaaaggcttcatttggtacgaatgattcttgtggcacatattttcaacgaaaagaagtccatctttcttcatccacttcgatattttctttagaagcaattcataattcttgatatgctcaaacacttcaatagccatcacacgatcgaattctttgttcaactcaactttagtaatgtcccctaatacgacctccacgttattcaatttataattcttgcattgctctttcacgaactttgtttgggatttcacatttgtaatcgcagttacatggcagtgaggatacttgcgagcaacataaatggctagagatccatatccggaaccaaggtctaaaatttgatcaccatctcttatttgtgctctttcgcaatatagatctagcatttcctcctcagcatcttctaatgtagtcgatttatttttaaagtagcacgtactcaatttcattaatctcccctggatgagcttcataaaagcgatgggcatctcatatgtatctggattgaaaccatttgtcgtgtcaagatccgcctgtcgtaaagattggacatagttgtggaggtgagcgagcctttgttcgcagtcgtgggtgttgatccactgaacacgcctttcgagctggtcccttatgagacgtttggcctcctcatctggtatgagccccagacccaacttctccaacacctctgcctttgttgccttcaatgcttcgctagtcatggtctcttctctagatctcttgagagcccaataagctagagagtcatctatatagtgctctctttatatacgtagtgagagagggagagaagc

SEQ ID NO: 457 - DNA, 1369 bp, Cissampelos mucronata
agagagagagagagagagagaacagagcaaagcagagcagccatggaagctctgtttcaagtaccctacaatgtcacagtgaagatgctgttggggtcgcttgagcgagctctgctcccagacatggtggtcaggagactcaccagactcctcttggcggctcgccttcgtcagggctacaagccctcttcgcagctccagctctccgaccttctccacttcgcccaatctcttcaggatatgcccatagccatcaggacggataagccgaaggaacaacattatgaattgcccacctcctttttcaagctggtgcttggaaagaatatgaaatacagctgctgctacttccttgataaatcgagctcattagaggatgccgaaaatgcaattttggagctctactgtgagagagcacacttaaaagatggtcatactgtccttgatgtagggtgtggctggggatccctctctttatatattgcacaaaaatatcctaactgcagggttactggaatttgcaattcaacgacgcagaaagcatgcatagaggaaagatgcagggaactgcaagtaaataatgtggagattatagttgcggatattagcacattggagatggagggcacctttgatcgtgttttctcaattgaaatgttcgagcacatgaagaattacaaagagttacttaaaaagatatccaagtggatgacacaagaagggctcctttttgttcattacttctgccacaagaccttcgcctaccactttgaggatctaagcgatgatgattggattacaagatacttctttacaggaggaactatgccttctgcaaacttattgttgtactttcaggaagatgtttcgatactcaaccattggttggtaaatgggaaacattatgcacaaacaagcgaagaatggttgaagagaatggactgtaacttggcttccattaagccgataatggaatccacttatgggaaagccgaagctgtgaagtggacagtgtactggaggacattcttcattgcggttgcggagctctttggatataacaatggcgaagaatggatggtcgcccatttcttatttaagaaaaaatagaacatggcgctgctaattaacgatttcgcgtttgtatgtatagggatgtgagtcttggtaactttgctttctttggttcattgagaatcgctacatccattctggtataaaagatggtcactggattgattagtgattgagttattgaggaaactatttggagtctctcagtcatgtttgaacattattaagtggcttgtgcaagtttgtaacatgtaggctttattttgaaccattaggatcagtgaatgaatgtgca

SEQ ID NO: 458 - DNA, 1533 bp, Cissampelos mucronata
taatataatcatttattttagtcttacttttatttggagtgtcgttctagcatcttccataataataataatataatcatttattttagtccaactaacatgcttgcttgcactacctttatttactccaaatctccattttatttcaatccatcatccattgatcgagtcgacgcatcattttttcttgaatagatagtaaacgtccatccactcttcgccgtccttgcatgtatacatctctgccccagtaatgcagagcactctccagtaattgatcattcttattgcatcttccttggatccatagaactcactgaatatctcttttattttctcaatgtttgcatctattctctccaccagcttcttgcaggtacggcctgtatgagtcccattagtagcccaatgacttacgactgaaagatcttcctgaaagtataagaggagagatgcagatggtacgatgaggtttccggatgggaaaatatactcattgtgccaatcttcatcgtcgagtgccttattattttggtatgcaaaggttttgtggcaaaaatgagtaacaaggagaaggccatcaggtttcatccaatcagaaacactcttcagaaataacttgtagtcatttatttcctccaacattccagtgacaaatacccgatcaaatgtggtggtattcagattgattgttgtgccatcccccactatcacctcaacattagataaattgagttttttgcattcttccatgatatattgcttctgttcgacaaagttggtgatgcctgtaacattgcaagtcctgtacttttttgcaatatgtataattaatgatccgtaaccacaaccaatatcaagaacactatgaccctctttgacgtttgccttctcacagcacgagtccatgtcctttatcattgattcttccaacgttgtggactcatcctcgtagtatgaaccactcattttgattatgcccccataaataatttgaaggaattcacttggtacgccgtacaaccattgttttgaggagccttggtcatccacattttccatcttcagtgatggaagagattgagcaaattgaagaaggtttgagagttgttctgcataggtgggcttgtaaccccacttaagacgcttttcaagtttagcctttgcgagtgttttgatgtcttcatccttgaccagcccaagctctggcctctccaactgctcttcaactctgctcttcaacttacgaatatcttcaatcttatgctccatttattgctaactatatgtagtcgtaatttaatgctactttcattgccatatatataactacgagaactataacaagtcagggtggtttggtggggaagcgggccgcttcgagtcagatcgagcgcgattcgattctctccgagggctaaactctgcgcctgaccaggaatatccgtgaaattgggcggtgacccgaggggattagtctgtgggaagggccatgggataccccaggtgagggcggggaaaaatgtttcgttc

SEQ ID NO: 459 - DNA, 1052 bp, Cissampelos mucronata
tgatctctctacgtaaattgaacattgcaactgctgtggatacattggactcagagatgtatgaggtgcccatctcctttttaaagatcatgtttggaaacacaatcaaaggaagctgttgctacttcaaagatgattcagtgacattagatgaggcagagatagcaatgttggatctctactgtgagagatcacagatcaaagacggccaaagagttctcgatctcggttgcggacaaggagctctaacaatgcacgtcgctcgcaagttcaggaactgtcatgttacaggaattaccaactcagtgtctcagaaagaatacattgaagagcagtgcaaaatcaacaacttgatgaatgtggaaattaaactagcagacataacgacgcatgaaatggaagatagatacgaccgcattctagtcatcgaattgattgagcacatgaagaactacgagttgcttcttcgaaagatatcggaatggttgacaccagatgggcttcttttcattgagcatatatgccacaaaacatttccctaccactatgagccgctcgatgaagatgattggtttacagaatacattttccctgctgggactatgatcataccatcagccaactttcttctatattttcaggatgatgttacggttgtgaaccactggactcttagcggaaaacattactcgcgtacccacgagtcgtggctgaagaacatagatgccaatgcagaggcagtgaagaaaataatggtatcgttcacaggcagcgaggatgctgcattgaagcagatgaactactggagaggattcaacttatcaggaatggaactctacaagtatagaaatggagaagaatggatggcctctcatgttctattcaagaaaaagtgatgatgatgatgatatatagatgcatatatgcaaacctagctacaacctagtcataataattgtggaactcaaatgaggagctattaatcttaaagtcgatcaccggttacctcgaaaaggagctattaatcttaagtcgatcacggttacctcgaa

SEQ ID NO: 460 - DNA, 1234 bp, Cocculus trilobus
tccacaggaccacaccaactaatctcaacatattttatataagttttctggaagtgaagaagtaaaatagcttgttgtgctggtacwgtgtaataatggcggtgggagcaggagataatcgtgatctggtggaaccgaagaacgataagaaggaagaagtggcggagctgttgaggaagttggagttgggacatgttcctgatgatgagatcaaacggctgataaaggtggagttggataggcgtattcaatggggttacaaaccaacctacgaacagcaaaccgccgatgtcgtcaatttcgctcattctctacgtaaaatgagcattgcaactgagatggatacattggactcagagatgtatgaggtgccaatctcctttttwaagcttatgtttggaagcacgatcaaagcaagtctgctacttcaaagatgattctacgacgttagatgaggccgagatagcaatgttggatctatactgcgagagatcacagataaaagacggccaacgacttctcgatcttgggtgcggccaaggagccctcaccatgcatgttggtcggaagtataagaactgtcgtgtcactggagttaccaactcggtttctcagaaagagtacattgaagagcagtgcaagatcaacaatttgacgaatgtggatgtcatactagcagacataaccacgcatgtaatggatgatagatacgaccgkatactagtcatcggattgtttgagcacatgaagaactatgagctgcttcttcgaaagatgtcagaatggatgacgccagaggggcttcttttcattgagcacgcatgccacaaaacctttgcctaccactatgagcctctcgatgaagatgattggttcacggaatacatttttccttctgggactatgatcataccatcagccaattttctactttattttcaggacgatgttgcgcttgtgaaccactggactctcagtggaaaacattattcgcatacccatgagtggtggctgaagaacatagatgctaatgcagaggcagtgaaaaaaattatggaatccttcacaggcagtgaggaggctgcagtgaagcaattgaactactggagaggattcacttatcaggaatggagctcttcaagtatagaaatggtgaagaatggatggcatctcatgttctcttcaagaagaagtgatacaaccctctgataatttatatttgtaggaaaacttg

SEQ ID NO: 461 - DNA, 1203 bp, Cocculus trilobus
gataatcgcatgtggctttttatctaaagccagcatcccaaatgctttaatatgactaattaaaaaaccaagatgcaatatataaaaccatcttaaagaaagctaaaagttgtcaaactcatacaatttaacctcaatctcatcactttttcttgaagagaacatgagaacccatccactcttcaccatctctgtatgcaaacatctctgccgctgttatgagaaacactctccagtagttaatgaaccttattgcatcttctttgcttccataacattcaatgaatatctcttttattgcttcgattttagcatctattctctccaacagctcctcaaacttataagccgcatgctttccgctgaaggtccaatgatgtacgattgaaacatcttcctggaagtataacaaaagtgaagcagatggtataatcaagcccgcagatgggaaaacatactcgttgaaccaatcgtcaccatcatcaagaggcttattttggtatgcaaaggttttgttgcacagatgttcgacgaagagaagaccatcatgtttcatccaattagaaattcttctaagaaatagtttgtagtcatttatatgctcaaacattccaagggcaaatactcgatcaaatgtggtgttcattttgattgttgctacatccgctaatattacctcaacattagataaattaagttttttgcattgttccatgatgtagtctttctgagaaattgagctagtaattcctgtgacactacaactcttgtacttttgtgcaacatgtagagtaaatgctccatagccacagccaagatcaagaacactctgaccctcttttatccttgccctctcacagcacaaatccatgttatgtattatagcttcttccaatgtagaagattcatccttgtagtatgtaccactttctttgatgatgtctccataaatgagctgaaggaatgaagttggtgtctcatacaaccaagcttttggggagtcatcctcacttgccatgtttaatgatgggagagagtggatgaaccgaagaaggtgagagagttgatcttcatgggtagctttataaccccattcaagacgctttgcaagtcgagtttttgtgagttttctgatctctccgtctggtaccagcccaagctctggtctctccagcagttctgcaacactactcttcaacccat

SEQ ID NO: 462 - DNA, 1839 bp, Eschscholzia californica
  misc_feature (1352)..(1353): n is a, c, g, or t
gataaaaaatagagaatagaaaacaacatgtgagtctgaaaataggcctaaatggccaatttatacgtgaatccatttttccaaagataaatgatgctacttactgtagtcatgccatttcctactcaacacaaatgcaatgatatacaaatagacgaggtgtttagcaacaacacttgtgaaacccactcgctttattttaatacgaggatcaattaagagaaattattttttcttgaggaggatatgagaaaccatccattcttcaccattgttatatccaaacaactcaattccacacatgcagaaaattctccaaaaattaaccaaccttactgcttcttcctctgttttggttatagacctcattatacctttcacttcatcaatgtttgcatcaatgtttttcaaccattctccatgggagcgagagtaatgttttccattcaaagatgaatgttcaacgacggagacatcatcctggaagtataaaagcaatgaggcagaagacaatgtcaaagttccaccggggaagatgtactcagtgaaccaatcttcttcgtcaattggctcgtaagggtaagccaatattttgtggcaaacatgttcaatgaaaagaagtccatcatctttcatccattttgaaatctttctaagaagtaattcgtagttcttcatgtgttcaatcaattcaatggcaaaaatacgatcgaatgtctcttccatttcgtatgctgtcacatctccaattataaccctaacatttgttaagttcaattccttgcatttgttctcaatgaaatctttctgccattgacaacttgtgattccagtgaccttacaatttttatacttattagcaacaaagagagtgactgctccaactccacaaccaagatcaagtatgctttgaccatcttctattttagccttttgcgtgtataaatccaacattgctccctcagcttcatccaatgtcgttgattcatccttgtaatacgaacaactttctttgaggtgtgttcctagctggattttatggaagtcaaatggtgcttcatacagccttaaatcaaagctttcatattcctttgaaattttcattttcttcagagagtgaataacatcaagaagttgagcaagttgttgttcatggttgggtttataaccccatttgagtcttttttccaattgggatcttatgtgtttcctaatatcttcatcaggaaccaaccctagttccatgctcttcaagagctcttccttctccactttcaaatccaccatctctatttgctcaaaatacacaagctagagaccctaaaataaatctaaagagagagagagagatnnggaagattttgagagtcaagtgaagaagagaggaaaggatgcaagtacccgtgatgaagatgaagaaattgaagatcctcaagaagaagattatggtgaagaggaaggtggcattttggatgaactttgtgaaggcctgagcaagatcaatgtgcaggagaagaaaattgctgaattcgagggtaaacatactcggtttatctacaatagtgatgatgaaattgaaggggaagaggagattttgcctgcttcaccgagtatattgcgcttgaaaggtatccccactcccgcaggcaagcacctccgattcgctgacgagtgaagttctactccttggtttaatagcatcttctgttatctgtgagtgtcttcctttgacaccattgttttgatgttttttttagctctgttttagttcctatgtctctagttttttctaggttataaaaaccctttaagatgattcattaaaggagataactttgc

SEQ ID NO: 463 - DNA, 1081 bp, Eschscholzia californica
  misc_feature (606)..(606): n is a, c, g, or t
atggcggcagatctggtagtaaagaaatggaataataagaaggaacttatagatgaaatggaactagggttagttggagatgaagagataagagaactaattagaaatgatttagaaaagagactcaaatggggttacaaatccaaccatgaacaacaacttgctcaacttcttcactttgttcactctctgaggggaatgaaaattgcagcagatgaggtggaaagtttcaatataaaggtgtatgaagcaccattttccttcaacaaaatccagcttgggagctccctcaaagaaagttcttgttactacaagcacgatgaaacgaccttggatgagggggagattgcaatgatggaattatatacagagaaggcacaaataaaagatggtcaaagtgtacttgatcttggttgtggtttgggttctcttactttatacgtcgccaataagtatcctaattgcaaagtcactggaactactgcttctctatggcataaagacttcatcgaaagcaaatgcaaggaacaagagttgacaaacgttaagatagtgctaggagatgccacaactcaygaaatggaagagaggttcgatcgtatattnagctattggattgattgagcacttgaagaactatggactgcttcttgggaggatatcaaaatggttgaaagatgatgggtttcttttcattcaacatgtctgtcacaaaaccttggcttacccccttgtgcctgttgatgaagaagactggataggtgaatacatcttccctggtggaaccctaaccatgccctctgcttcattacttttatacttccaagatgaattatcagtcgttgaccattcgactttgaacggaaaacatttttctcgcacacatgaagaatggttaaaaaatattgatgcaaaaattgatgaagtgaaagaaatactgaaatctgtaacaaagacagaggaagaagtagtaaggttaactaatttttggagaattttctgcatgtttggggttgagatgttcggatacaacgaaggtgaagaatggatgctttctcaaatcctcttcaagaaaaaatga

SEQ ID NO: 464 - DNA, 1438 bp, Eschscholzia californica
tgagcaaactttatcaagttacaaaattttaaggtacattattttttttttttttggaagtcgactaacagaaccgggcctatagcccaacaagacatggcctaaagcccaacaacattatttacaccctaataaccccaattcaaataaccaaagattccaccttctctgggattcgaacctgggacctccagggatttctggagtttatgtcaacaccttggaaccacttgggctaccaactgttgacaaggtacattattgattaaagatagaaataatatagtctcattaattaatcaatcaaacttgcatagaatttactttttcttgaaaagaagttgtgagaccatccattcttcaccattgttgtaaccaaacatttcagcagcactcatggagaggaatctccattctcctatcgtttttgtaacctcattttcactttttaagtttgaacgaaatatttgttttacttcatccatcttttcatccattcttttcaaccactcctcgtttgaacgagcaaaatgttttccattcagagtccaatgatcaactactgaaacatcatcctgaaagtatagaagaaaggatgatggtataaacgtcaatgttccagctgggaagaaatatgtagtataccaatcatcttcatcaagaggctcattgtggtaaccaaatgtcttgtggcaaagatgctctataaagagaagaccatcttgtgtcatccattttgaaaacttcttaagaagtaattcataattcttcatatgctcgattaatccgatggcgataatgcggtcgaagacattttctatttctgtagtgcatatgtctgctaaaataaccttaatatttgggacattaagagttttgcatttttcttcaatgaactctttttgtttgacagagttagttactgctgtaatattgcaacctgtgaactttgaggcaatgtggaatgagaatcctccaagtccacacccaagatcaagaatactttggccatcttttatttgtgccctttctaagtataaatccatcattgctatttcagcttcatccactgttgttgattcatccttaaagtaaagacaactttctttgatagtagtaccatgtattatttgtaggaaggataagggaacctcatacacagtggagtttaatgcatctatctccatggcaatttccattttcttcatggagtgagccaagtcaatgagttgagagagttgttgttcatgagtggatttataaccccattcgagacgtttttctaattcaactctcatgagcttcctgagctcctcatctgaaaccaatccgttctttaagcgcttaaccaattcactaaccctttccttcactgactctttgttattaacaaaactaccctcctccaccaaactagccatctatatgtatattctag

SEQ ID NO: 465 - DNA, 1650 bp, Eschscholzia californica
acacgaacctggtctctgaatggagaaactcatctgccaggcttagaatcaatgaccaacttcattcgtgtaaatccgagcatgcccatgtcaaaatgcaactcagatgcacatttccgaccagcaacaccctgaatctccgcaaagtcgtattggagagtgtgaatagtgactaatcatcatcatcgttatcatcgttatctaggtacaacagtttcggaatattgttgtttgtgttccttatcaatatcggggggacttctataattcacaacaaggcagggagaaactatctagccttttctctctagctagtttatcattacttgtagtagtagatggctttagagcaggaggattcgatgagtgttccagagaggaatgaaggtgttgctgatttgataaaaagaatggaactagggcttgtcaatgatgaggaaatcagaaggctaatgagaattcagattgaaaatcgtcttaaatggggttataaacctactcatgaccaacaacttgctcaacacctccacttcatcaactctctcaaggaaatgaagatggcaacagagatggactccttagattcacaagtctatgagtccccaaattcattccaacaaattatgtgtgggagaagtatgaaggaaagtgcaggattgtttatggatgatgtgacaactgttgaagaagcacatatcagaatgatggatttgtattgtgacaaggccacatttgaagatgggcagaaaatacttgatcttgggtgtggtcatgggtcagttgttttacacgttgcacaaaaatacaaaggttgtcaagttactggagttaccaactcttctgctcagaaacaatacatacttgagcaatgcaagaagcttgatttatccaacgtagaaatcatattggcagatgtaacaactcttgagatggaagaaaagtttgatcgtgttattattattggattgattgagcatatgaagaattttaaactattttttcaaaaagtatcaaaatggatgaaagaaggtggtcttctttttttggagaattatttccacaaggactttgcttatcattgtgagaaaattgacgaagacgattggtacgatggctacatctttcctcctggaagtttgttaatgccatctgcttcaactcttctttattttcaagaagacttgaccgtggcagatcattgggttcttcctggaactcactttgccaaaacttttgaagagttcttgaagaaaatagatttgagaatagaagaagtaagagaaatatttgaggcattttacggaataagcaaggaagaagcaatgaagttaagtaactattggaggaatttctgcataagtgcaatggagatcttcaattacaacaatggtcaagagtggatgatctcccatcttctctacaccaaaaagtgaatgagtcatccatccatatatctttaatttaatggcttgtgcacttggtgtttaatttccttatgttgattgggttgtggtttgaaagataagtaataatcctttgtgtggtgagtggaatcaaattggatatttgaatatgtatgtttgttttgtaaacaaattactagtttgtttgttgtggtttgaaagataagtaataatcctttgtgtggtg

SEQ ID NO: 466 - DNA, 1336 bp, Eschscholzia californica
tcttcaatgaagatttggttttcttagagagagaaagtgattttttagagagagagagagagagtttcatttcttgaaggatacgatagagagagagagagagaagagagagagagagagaggccatggatgcgttgatacaggtaccatataatgctacagtaaaagttatgctgagttcacttgagagaaatctattaccagatgttgtgattaggaaactcactaaattgttattagcaagtcgacttcgattgggttataaacccacttcagatcttcaactctctgatcttcttcaatttcttcactcattagaagagatgccaatagcaatcaaaactgatacagctaaaacccaacattatgaattacccacttcttttttcaaccttgttcttggttcacatatgaaatacagctgttgttacttcactgatgagtctaagagcttggaagatgcagaagaagcaatgttggaactttactgtgagagagcacaaataaaagatggtcatactgttcttgatgttgggtgtggatggggatccctttctttatacattgcacaaaagtatagcaattgcaagattacagggatatgcaattcggtaactcagaaagcacatattgaagaacagtccagggagctgaatttgaataatgtggagatcattgtagcggatattagtacacatgagatggaggcctcttatgataggattctatcaattgagatgtttgagcacatgaagaactataaggagcttcttaagaagatatctaactggctgaaacaagatagcctcctttttgttcatcacttttgtcacaaagcatttgcttaccattttgaggatacaagtgaagatgactggataactagatacttcttcactggagggacaatgccgtctgctaatctacttctttacttccaggacgatgtctctgttgtaaaccattggctagtaaatgggaagcattacgcacaaacaagtgaagagtggcttaaaagaatggacaaaaacttgaactctataaagccgataatggagtcaacttacggtaaggaatcagcagtgaaatggactgtgtattggcgaacattttttatctctgtggcggagttatttggatacaacaatggagaagaatggatggttgctcattttctattcaagaaaaaataggaatttgggatttagtattttcatcgttgtcttggaattttcggtcatgttttgcatttcgatacattgttaagagacttaattcgtatccaccttaatttgtatcgaccttaagctatctaagtttttgtgcgttctgaaca

SEQ ID NO: 467 - DNA, 1431 bp, Eschscholzia californica
aaaatccccttttcgcatcaatatcccaatccataatccctctttctctgcaaaattgtccctctctagattttgttattgagaaggaaattctgtgattagtaaagaaaaaaaaaagatgggatcatcagctggggagatcatggggaggttgatgaaaggagaaattgaagatgaagaacttaagaagctaattagacatcaatgggacagacgtatcgaatggggttacaaacccactcatgaaaaacaattagctttcaacttagacttcattaaaggattgaaagagatggttatgtcaggggagatagacacaatgaataaagaaacttatgaattacctactgctttcttggaggcagtttttggcaaaactgtcaaacagagttgttgttacttcaaagacgagaactcgacaattgacgaagcagaggaagcagcccatgaattatactgtgaaagagcacaaatcaaagacgggcaaacagttcttgatatcggttgcggtcaaggaggtctcgttctttatattgcggaaaagtataagaactgtcatgttacaggtcttactaattcaaaggcacaagcaaactacatcgaacaacaggcagagaagcttgagttgacgaacgttgatgtaatattcgcagatgttactaaatttgacacggacaagacatatgatcggatactcgttgttgaaactatagaacacatgaagaacattcaactgttcatgaagaaattatcaacttggatgacagaagacagtcttctttttgtggatcacattagccacaaaactttcaatcataactttgaggcactcgacgaagatgactggtactcaggtttcatcttccccaagggttgcgtgaccatactgtcatcttctactcttctctactttcaggatgatgtttcagctctcgatcattgggttgtcaacggaatgcacatggctcgttcagtagaggcatggaggaagaaactcgacgaaaccattgaagcagcaagagaaatacttgaacctggccttggaagtaaagaagcagttaaccaagtcattactcacataaggactttctgtataggagggtatgaacaattctcatacaacaatggagaagaatggatgatcacacaaattcttttcaagaagaaatgaatgaaaactcttcttcaccgaattgcattttcattttaagttccatctaataaatggggtttttcttgtgttaagaattgtttgtaatttgaggtttatttggcttgatgtttcgttacctaaatttctctttcgagattgttgaactaagatgcttcggttctgtttgttttcttttaagatctgaacctgaactttagttttatttctgtgtaatttacttgtataatttaattcttgtacttctctagtaaaatcaa

SEQ ID NO: 468 - DNA, 1349 bp, Glaucium flavum
ggagcttcattaatggatgactcaaatcaaacacaattttatttaaaacatacaacacatcattttccattagacatatatggattaattaagcataagcaaaaggtggtggaatccacaaatcaagaagttaattaattaacattgttgtagtaattgttttttcttgaatagaacatgagacatcatccattcttcaccatccttgtatccaaacagctcagctccacacatgcagaaaatcctccagaaattgatcaatttcactgcttcttcttcagtcttggttatggacttcattatttcttttactgcatccatgtttccatctattctcttcaaccattcctcatgagaacgagagtaatgttttccacttaatgtccaatgattcacgactgaaacatcgtcctggaagtatagaagtaatgaggcagatgataaggttagagttccggcagggaagatgtattcagtgtaccaatcatcttcatcaattggctcatagtggtaagcaaaggttttgtgacaaacatgttcaatgaaaagaaggccatcatctttcatccattttgatatccttctaagtagtagttcatagttcttcatgtgctcaatgagttcgacagcaaagatgcggtcgaacttgtcctccatctcatgacttgttacatctgctaatataaccttcacatttgacaaattaagttccttgcatttgccctctatgaaatctttctgctctacagagtttgtaagtcctgtaacatggcagtttttatactttttcgcgacgtgtagagtgacagctcccaatccacacccgagatcaagtacgctctgaccatcttctatttgtgccctctctacgtataaatccagcatggctatctcagcctcgtccaacgtcatcgattcatccttaaagtaagaagaactttctttaatggtgctaccatgcttgatttgtacaaaagaaaaaggtgcttcatacaacttcaaatccaaactttccatctccgtcgcaattttcattttcttaagagaatgaactaggtcgagaagttgagcaagttgttgttgatgggttggtttataaccccatttgagacgtttttctaattcaattctgatgagtcttcttatctcttcatctggaactaacccaagttccatatttttcaatagctcttccttcttctttacttgtttactagtagccatcaaatccatttcaagaacacaaccaggaggagcaagagaatgaagctagtagctaggattatggattggggtttgatggttggttgaatatatgtagatgatgactagtagtactacaaagtgtt

SEQ ID NO: 469 - DNA, 2048 bp, Glaucium flavum
gagatggaatcccatatttaataaacttctggccaattggttgttgatgtaatcaaacaattacaacagttattaacacaagaaaaccccattattacatagtagaactcttggaaattaatacagttgatgcatgtagaaattggtatatagatcacttcttcttgaagagcatctgtgcaaccatccattcctctccattgttgtatgaaaattgttcatatcctcccatgcagaatgtccttatgtgtgtaataactccatttactgcttctttgctaccaagaccaggtaatagtatctctcttgcaagttccatatttttgtctagcttttttctccatgcatctactgaacgagccatgtgcattccgtttacgacccaatgatccagaattgtaacatcatcctggaaatagaggagggcagaagccgatagaattgtcacacatcccttggggaatatgaaacctgagtaccaatcatcctcatcgattgcctcaaaatgatgactaaacgttttgtgacagatatgatccacaaaaagtagactgtcttctgtcatccatgttgatagtttcttcataaacagttgaatgttcttcatgtgctctatagtttcgatgacgagtatccggtcataagtcttatcactttcatgtttagtaacatctgctaatatgacatcaacgttcgataattgaagtttctcagcttgcatcaaaatgtaattcttttgtgcttttgaattggtaagccctgtaacatgacagttcttatatttctgagcaatatgaagaacaagacctccttgaccacatccgatatctagaacagtttgcccgtctttgatttgtgctcgttcacagtataactcgtgtgaagcttcctccgcttcgtcaattgtcgtcgtttcatctttgaagtaacatccactttgtttgatggtctttccaaaggctgcttctaagaaagcacttggtaattcataagtctcttcattcatagtatcaatttctcctgacatatccatctcctttagagatttgatgaagtcaaggttgaaagcaagttgttgttgatgagtaggtttgtaaccccattgaagacgcttcccaaagatttctttaatacgtttgcttagctcttcatctccaatttcaccttgcatcaacttccccatgatctctccaattgattccttcttcacttgtgcttcatttgaacccatttccaaactcaaaacaaaacttacaaaacaaaaaaagagagacagatagtgaatagmacaatagcaaaaagatggagaaaagcttacatttaagagagatttcgaagttggttgacaaagcaacaaaccgaagttcaacaaagaagcaaagtgtagcaacaacaactgcttacccgggtaaagacccaagcttacccgggtaggataagcagaattcgagcaaataatgtggaaaaaccaaggtatacccgggtaggatatttccttacccgggtaggatgccagtttccagaatccgaccagtttcctttttgaaatctgttaccaattcaagtcccgattgaattccaattcttctatgcgttttgggacgacttcaaggctatttaaagacctcaagagcacctccaaaatcatcatctatcatcacaaataattaattcgagtctttggagttgcgcaagaggagaggagacatcaaggagacgaggaagctttggaagatcttcgaaaggggtttattcatggctctctttactctttttgctatgtttactttcaatatgtgtagctaaacctttctttacagttgtgataaacttgaagcttaatattaatgttttattcttaatttgatccaatctatttattgtttctctattggaattgtatcttgtttactgcgtttaatgtttataaactgatttgtgagttatttagagtgcacgctagataatttatagattaagtttatagctatctaatactttcgtaatccggaattgttatgagagtatagaattagtagcaaattgtg

SEQ ID NO: 470 - DNA, 1345 bp, Glaucium flavum
tcccatgcatagacatcgatttatattatattccaaactattcatttttattatatttaactttactaattctattgagctatcaacaaacaacagactttactaattcttattaattgcaccacaattattactacttaatttgacatgatcgtcaaaacgaatgcaatacgtaagatcaaatgcatgcacaaagacttgcatggatcactacttcttcttgaaaagcacatgagagatcatccattcctctccattgttgtatgagaattgttcataccctcctatgccgcatgtcctcatgtgtgtaattacttggttcgctgcttctttgctcccaaggccagcctctagtatctcttttacagcttcaatatttttgtttagtttctttccccactccacttgtgtacgagccatgtgcattccgtttagcagccaatggtccacaaccgaaacatcatcctgaaaatagagaagcgcatttgcccataatatggtcacgcttcccttgggaaatttgtaacctgagtaccaatcgtcctcgtcgagtgcctcataatgatgactaaatgttttgttgcagacatgatccacaaaaagaagaccatcctctttcatccagcttgatactttcttcataaacagtgccatgtttttcatgtgctctatggttccgatgaccgatactcgatcaaatgttttctccatatcaaatttagtaacatctgctaatataacatccacatttgataactgaagcttctctgcttgagtggtaatgtaattcttctgtccatttgaattggtaatccctgtaatatggcagttcttatatttctgagcaatatgaagaatgagacttccttgaccgcatccgatatcaagaatcgtttgcccatctctaatttgtgctcgctcgcagtataactcatgacaagcttcctctgcttcgtccaacgtcatcaattcatctttaaagtaacaagcacttattttgatggtctttccgaatatagcttctagaaaagctgtaggcagttcataagtttccttgttcatggcctctgtctcccccgacatctccagctctttaagggattttaagaagtcgagattgaaagcgagttgttgttgaagggttggtttataaccccattgaagtagtctctcaaactggaacttaatgagctccctcagctcttcatcttcaatttggcccttcatcaccctcccaaggatctcctcagctgattctttcttcatgatcccaacttctttactatccattaattctaactagctagctaatgggaggagaaatgagagaaatggtaagttaagc

SEQ ID NO: 471 - DNA, 1144 bp, Glaucium flavum
aagttaatttgatagagatcatgactatggaggccaacaatgcaaagaaagaagccattgaaaatctatgggagcaaatgatgatgggactagtcccggaccatgagatcacaaggttgatgaagagtgagttacaaaagcgtcttaattggggttataaacctactcaccaacaacaaatttctcaactccttgatttcgccaaatctctccgacgcatggaaatgtccctggattttgataacttggagttggacacgaagatgtatgaaaccccagaatcatttcaactcatcatgagtggaaccaccctcaaagaaagttcaggtttgttcacggatgaaacggcgacactagaccagactcaaataagaatgatggatttatatttggagaaagcgaaaataaaagatggacagagtatattggatcttggatgtggacatggagccctcattttacatgtcgcacagaaataycggaactgtaacgtcaccggtgtcactaattcgatagcscagaaagagttcattktyaagcaatgcaagaagctcggtctatcaaatgttgagatggtattagcagatgtaacgaagtgcgaaatgaaagctacattcgaccacatatttgtcattggactaattgagcacatgaaaaactttgaactatttcttcgaaaagtatcggaatggatgaaatcagatggacttctgttcatggagcattactgtcacaaaagctttgcttaccaatgggagccgatggatgacgatgatttgttcagtaagtatgtctttccacctgggtcagccattattccgtcagcctcatttcttctgtatttccaggatgacttgactgttgtagatcattggactcttagtggaaatcatttcgcgcgcactcaccaagagtggttgaaaagaatagattcccaaagtgatgaaataaaaggaatttttgagtcattttatggaattagcaaagaagaggctgtgaagttaattaactactggagagttttctgcttatttggagttgagatgtttggatacaacaatggtgaagaatggatgatttcacatcttctcttcaagaaaaaataaatcttttcttctttgtgtttattcattcaagagttttt

SEQ ID NO: 472 - DNA, 1383 bp, Glaucium flavum
attcgatgaaatattaattaatttttattagtaatagtgacgataacatagtgttttttatgttatatttgttgataacatatgtttgaatctccgctctatatgagcttttacacggattcatctcaacaacaacaaaagaaaaacagaagtataaaattaccatagagaaaaataacacctcaaagaagctcaaagaaacattgtaacaaaacgatatggataacaacttctttattatgagctccatgtatcaaatttattttttcttgaagagaacttgtgaaaccatccattcttcaccattgttgtagccgaacatctcagtcgcattgatggcaaggaatcgccaatggttaattagttttgtaatgtcatgatctttattttcgaatgctgcctcgagtatttcttttacttcatcaatcttcatgtccattctcttcaaccattcttcattggaacgagaaaaatgttttccgcttagagaccagtgattcacaattgagacatcatcctgaaagtatagaagaaaggatgatgatattatagtcaaggttccggctgggaagaaatactcagtgtaccaatcatcttcatcaagtggctcataatggtaagctagtgttttgtgacacagatgctctataaacagaaggccatcttgtttcatccaatttgagaacttttttagaagtagttgataattcttcatatgctcaagcagtccgatagcgaagatccggtcgaaggtggtcttcatttctaaggtgcatatgtctgctaaactaactttgacattttctaccttacgaattttgcatttttcctctatgaactctttttgttcaactgagttggtaattgccaaaacattgcaatttgggtacttctgcacgatatgaaaagcaagcgcacccagtccgcaaccaagatcaaggatgctttggccatcttttatttgtgtcctctctaagtataaatccatcatcgcaacctcagcctcatcaagtgttgttgattcatccttgaaataacaacaactttccttgatggcgcttccaaattgtaattgtaggaagggaataggtacttcatacattgtcgaattcaacgaatccgtttccgtcgctattttcatttgcttagtagagtgagccaacttgagaagctcagcaagttgttgttcatgagtaggcttataaccccatttgagacgcctttctaattcaaatctgattagctttctcaactcctcatcagccactaatcctgactccaaacgcttcaacaagtctggaaccatttctttggtctttagttccccattagtttcgttagaacccataatttcaaaagcaaaacaaaaaataaccaaaaaag

SEQ ID NO: 473 - DNA, 1364 bp, Glaucium flavum
tgactctgtaatttctacgcccatttttggagagaaaaagagaatagaaactggcctttcattcaaatgaactgaaaatcaaaatttttaaattagcttccattctctttttctctccaaaaatgggcgtagaaattacagagtcatcatcaacaacaatggcaaataagaaagcagaagttggggaactgttgagaaaattggagcatgggttactaccatatgatgagattagacgtttaatgaggattgaattgggtagacgtctccaatggggttacaaacctactcatgaacaacaactttctcaagtcctcaaattagctcgttctctgcgtaccatgaacatcgcgacagagattgatacgttggacgagcaaatgtatgaggttcccatcccattcctacaacttatgtttggaagcaccattaaaggaagctgctgttacttcaaagatgattcgacgacattagatgaggctgagattgcgatgttagacttgtactgcgagagggcacaaataaaagatggtcagagtgttcttgatcttgggtgtggccagggagctcttactctacatgttgccaacaagtacaaaaattgcagggttacagcggtcacaaactcggtttcgcagaaagagttcattgaggagcaatcaaggaggcttaatctgaagaatgtcgaggtcatgctagcagatataaccacacacgaaatggaggacacttacgatagaatattggttatcgaactgttcgagcacatgaagaactacgagctacttctacgtaagatatcaaaatggttgtcgaaagacgggtttctcttcatagagcacatatgccacaaaacctttgcttatcactacgagcctatcgatgaagacgactggtacaccgagtatatcttcccagctggaacaatgatcataccatctgcctcctttttcctgtacttccaggacgaccttacagttgctaagcaatggacacttagcgggaagcattttgcgcgtaccaaggaagaatggctgaagaggttaaatgccaatgtagatgaagtgatgaagataatggagtcattttcaggcagtaaagaaggtgcagtgaaatggactaactattggagaggattctgcttatctggaatggagatgtatggatacaacaatggtgaagagtggatggcttgtcatgtgctgtttaagaaatgatttagcttttcagtatctttacttttgaaggcatctttgccaaactgcccttgaataagtttttcgaattccatagtccttaagatcaatttgggcaacttttgtatggatggtttagagaactacagttgaaataaatctaagaaa

SEQ ID NO: 474 - DNA, 1077 bp, Hydrastis canadensis
atggctgtggaagctcagcaaccaaagaaggcagcaattgtagagctattgaaaaagttggagttaggattggttccatatgatgaaataaaaaagcttataagaattcaattagaaagacgtcttcaatggggttataaatccacttatgaagaacaagttgctgatgtacttgacttggctcatgctctacgaaagatgaccatagccagggaggtcgagacgttggattctcaattgtacgaggtgcccgtagaattcctaaagattatgaatgggaacactttgaaaggaagttgctgctacttcaaagatgattcaacgacattagatgaagctgaaattgaaatgttggatttatattgcgagagggcacaaattaaagatggacaaagtgttttagatcttgggtgtgggcagggtgctcttactttacatgttgctcaaaagtacaaaaattgccgtgttacagcagtaaccaattccgtgtcacagaaagagtacattgaggagcaatccaggaatcaaaacttgtccaatgtggaggtcatattggcagatataaccacacacaaaatggatgacagatttgatcgaatattgattattgaattatttgagcacatgaagaactatgaacttcttcttagaaagatcacagaatggatggctcaagatggacttctttttgtagagcatatttgccacaagacttttgcttatcattatgagcctcttgatgaagatgattggttcacggaatacgtatttccagctggcactatgattataccatcagcttcattctttctgtatttccaggacgatgtttcagttgtgaaccattggactcttagtgggaagcatttttcgcgtaccaatgaagagtggttgaagagactagatgcaaacattgatactataaagccaatgtttgagtccctaacggggagtgaagaagaagctatgaagttgattaactattggagaggattttgcttatctggaatggagatgtttggatataaaaatggtgaagaatggatggcatctcatcttcttttcaacaagaaatga

SEQ ID NO: 475 - DNA, 1126 bp, Hydrastis canadensis
cacactctctcttatttgtctgaaatagctatggaaggtaagcaagcaaagaaggaatccattgtagagttgttaaagaagttggaacttggattggttccagacaatgagatcaaacaattgataaggattgaattagcaaggcgtcttcaatggggttataaatccacttatgaagaacaagtagctcaagtccttaacttggctcattccctacgacacatgaagattgcaaatgaagttgatactctggattctcaagtgtacgaggtgtccatgtcttttctaaacattatatttggaagcaccatgaaagaaagctgctgctatttcaaggatgattcagtgacattagatgatgctgaagtagcaatgttggatttatactgtgagagggcacaacttcaagatggtcaaagagttctggatcttgggtgtgggcaaggaactgttactttatttgttgctgagaagtataaaaattgccatgttacagcaatccctaattcagtgtcacagaaggagtacattgatgagcaatgcaggattcgtaacttggtgaatgtagaagtcatattagcagacataaccacatttgagatggatgacactttcgatcgaatatttgtcattggattatttgagcacatgaagaactatgaacttcttcttaaaaagatttcaaaatggatgactcaagatgggcttctctttgtggatcacatatgccacaagactcttgcttaccactatgatcctctggatgaagatgattggttcacggaatacgtttttcctagtgggacaacaattataccatctgcatcattccttctgtactttcaggatgatgtttcagttgtgaatcattggatccttagtgggaagcatttatcgcgtacccatgaagagtggttgaagagattagatgcaaacattggtgctataagaataatgttcaagtccttattaggcaaagaggaagctgtcttgaagttggttaactattggagaggattctgcttatctggaatagagttatttggatataacaatggtgaagaatggatggtatctcatgtactcttcaaaaagaaatgatatatattggtttttgtattatttc

SEQ ID NO: 476 - DNA, 1337 bp, Hydrastis canadensis
gctgcgcagattcacagagttcttaagttctctctaaaaccctaaaaacacacactctctagatctctctctccagatctctctctctctagaaagaatggagtctaagcaaattaagaagatagggtcagcaatggagatccttgagaggctagacaaaggcctcattccagatgaggagctgagggaacttgttaagatccaatgggggaggcgtttaaaatggggatacaagtctactcatgtacaacaactggaattcaaccttgacttcgtaaaatctcttaaacaaatggatatgtctggaaagatggaagttatcaattctgaatcctatgaattaccagtagcattccttagagccatgtttggaaagactctcaaacaaagttgttgttactttgaagatgaatcaatgacattggacgaggctgagactgcggcgcatgaattatattgtgaacgagcacaaattaaagatggtcaaagagttttggacattggttgtggacaaggaagtttgattattcatattgcgcagaagtataagaattgccatgttacaggaattaccaactcaaatgcacagaagaacatcatagaggaggaatgcagaaacctcaagctatcaaacgttgaagttatactagccgatgtaactcaatatgacacgaaagacacattcgatcgaataattcttatcgaagcagtggagcacatgaagaacattgatctattcttgaagaagatatcaaagtggatgaaagatgatggtcttatgttcatagactgtatctgtcacaaaacatttggtcatcactttgaggcgatcgacgaggatgattggtactcaggatatatctttcctaaggggtcagttacccttcaagcagcttcaactcttctatattttcaggaagatgttgcagttgtcgaccagtgggctgtaagtggaaagcatatggcccgtacagttgaagagtggctaaagaaactagacaagaacatagatgttgcgagagaaatactagaaccatctcttggtagcaaagaagctgttgaaaaagttataactcattcaaggaccttttgcattggaacttctgaacaattctcttacaacaatggagatgaatggatgatttcacatgttctcttcaagaagaaatgattcagttccatgagcagatctatttgataatggatggatgatttacatgaaccatatttatttaccaagctcaaatgtgtccaaactttattattaaggttaataaattatcttttccaagtcgctttgagccattatatagatgaagtatatatggccaccaaca

SEQ ID NO: 477 - DNA, 1358 bp, Jeffersonia diphylla
acatacacagaacacaactagttccttttggcaattgaatattttttgcagctatgagtaaaggtgttgcaaagctggtggagaggatggagcttgggcttgtttcagatgatgaggttagaagattgatgagaattctaatagagaaacgtctcaaatggggttataaacctactcatgaagaacaactaacctatctcaccaacttcattcagggtcttaagggaatgaaaatagcagaggagattgatgctttagatgctaagatgtatgagatacccattgcgttcatgcaaattctttgtggatacagtctcaaattcagtccaggcttcttcgaggatgagtctaccacattagatgaatctgaaactatcatgatggacctatactgcgagagggcacaagtccaagatggtcaaagcatccttgatcttggttgcggacatggaggtttcgttctacatgttgcgcaaaaatataaaaactgtaaagtcacaggggttaccaactcagtatccgaaacagagtacataatggaacagtgcaagaagcttggtctatccaatgttgaaatcataatagcagatgtaaccaagtttgaaccagaggttacctatgatcgggtgtttgctattgcattgattgagcacatgaaaaattatgaattagtcctacaaaaattatcgaaatgggtggcacaagatggatttctttttgtggaccatcattgccacaaagttttcccttacaaatacgagccaattgacgaggacgattggtacactcagtacatcttccctggtggcactttggttttaccatcagcttcaattctcttatactttcaggaagacgtctcaattgtaaaccattggactctgagcgggaatcatcctgcccgtggtttcaaggagtggctaaagagattagatgataatatggatgaaataaaggcaatttttgaaccattctatggtagcaaagaagaagctatgaagtggattacctactggagagtattttgcataacacactcggagatgtacgcgtacaatggtggtgaagaatggatgatttcacaagttctcttcaagaggaagtgaattacacatctgtagcatctacggaataatctgtattagatgaattggtaaacatccattgaataagatctccagagaggactcggttacacacggatgagtgaaagtagcactagcatagtagcttgtgttcagtttgtctgtcctcaaaatgcggcggccatgccttacattttcttgaatgtagtttgaatatccctatactgatgtaatttggaatgtatcaaacaaccctataatataatatgtttg

SEQ ID NO: 478 - DNA, 1740 bp, Jeffersonia diphylla
gtggtagtaagaatggcaattgaatgtaccacaaatatgttagatagcaaaatttcagaagtataactcaacctttttctgattataggagctcccataaatggacagatgaaagcatcaccttcaacacttgtaactaaaatcaagatcatatagctcaaaacattcttgatatagttcgtgttcacctcacctaacccaaacagatgatacaaattactctaattttaatttcaatggaagaccttttatgacagtttattaaacgaaggcatctgtaatgagaaaaaaaggaactccaaaagcaacgatcatttcttcttgaggagaagatgagatgtcatccattcttcaccattgttatacccaaacaactccattccagaaaagcagaaccccctccaatagttaatgaacttaaccgcagcttcctcagtgcctaaagacgacttgaaaatttcttttacagtatcaatttctgcatctaatctcttcagccactctttattggtacgcgaaaaatgcttcccactaagggtccaatggtttaccactgatacatcatcctggaaatatagaaggaaagacgctgacggtataatcatagtaccagcagggaaaacgaaatccgtaaaccagtcatcttcatcaagaggctgatagtggtaagcaaaagttttgtggcagatgtgctctacaaaaagaagcccatcttttgatatccattttgatatcttccgcaaaagtagcgcataattcttcatgtgctcaaacaattcgatgaccagtatgcgatcataagtttcatcactctcatgtttcgtaatgtctgccagtatcacttcgacattcgacaaattacaggacttgcattggtcctcaatgtactccttctgtgacactgaattggtaatagccgtaacatgacaatttttatacttttgagcgacgtgtaaagtaagagctccctggccgcagccgagatccagtacactctgaccatctttaatttgggctcgctcacagtacaaatccaacattgctatctcagcctcgtctagcgtcattgaatcatctctgaagtagctactacttcctttgagcatgctaccattcataatctttagaaacgagatagggacctcgtacatatgctcatcaagggtctctatctcatctgcaatattcatattttgcaaagaatgagccaagttgaggacttgagcaatttgttgttcatagatgggtttatagccccatttcagacgcctttccagctgaatcccgatgagtttcttaatctcattatccggaaccagcccaagctccaacttcttcaacagctctgcatttttactttctttcttatttgcttcacccacatccatcactgatttctagagttgatgcaaaaaaaaagagaaaaagagatggaattgaatgtccaagcaattcatcttcttgtttatataatgtagacttgaggagtaactcgcaaattcatctggtgggtgggtctcacctgctgcaccagactgagggggagaccaagttccagtttagatgctcttacacgggatatccgtgggttttgacttggcatttggaatgttgccatgttgcatgcatcttgtttctttcttttgtgtttgtgcgtgccctgtcatctacattttttggctttaactccggttagactaaattatgaagaatctaattcccttttagactttaacttag

SEQ ID NO: 479 - DNA, 1202 bp, Jeffersonia diphylla
ttttgttgtttatagcatactcatgacttcttaaacatgatttgtgagatcatccattcttctccattattgtacaagaactgttcactcattgcagcaaataagtttagacaatggttaatacatttttccgcagcttccttgctaccaaaggcaagttgtagtacgtctttagcaatatcaatattcttgactaggtttttgtgccacttttcatgtgtacggcccatatgcttcccgttcattatccaatgctccagaaccgtaacgtcatcctgaaaatacagaagagttgaagcagcgtgtacagttaccgaacccttggggaaaatgtattcagcataccagtcctcattatcaagttcctcaaaatgctcagggaatactttgtggcacacatgttccacaaaaagaataccgtcttccttcatccacttggatactttgtttagaaacaattggatgtttttcatatgctcaatggcctcaattacgaatactcggtcaaatcggtcctccatttcatacttagttacatcagctaatatgacctttatgtttgacaagctcagcttcctgcattgctcctctatgtaatttttttgctcagaggagtttgtcattccaaccactaggctgtttttgtacttcttagctatatgaaacacaagacttccttgaccacaaccaatgtcaagaatagtttggccatctttcaatctggcacgctcacaaatcaaattgttcattaccatctcggcctcatcaagtgtcggtgattcatccttgaagtaacaagcactttgttttagagtctttccgaacattgtttttaggaatgaaatcggtaactcgtaagcctctgcgtttatcctctccatgtctccagagatatccatttgttttagtgatttaatgaagtcgacgtgaaaagcttgctgctgttcaaaggtaggtttatatccccattgcagacgcttctgtaattgaataagcacaagctttttcagttcatgcagactaacttgtccaccatccaacctctccaacagctctataactgattcattcttctttggctggtttgagtccattgagaaagatgtctaagggtaaggagcaatggttcctcgaactttatgttggtctatctctttttgtttgtgttggtagccggaagtctcagcagaatctgtgccatt

SEQ ID NO: 480 - DNA, 1378 bp, Jeffersonia diphylla
gaacttctagaaaactccaaaaaaactgctgacattccacacttatcctctccacacattcatttcaccttgattccttgatcctctcctttctcctgcgtatactgagtagtaatggagggattgatagagatgccatacaatgcaagtgtgaagatgatgcttagtttgcttgaacgcaacctactacctgacaccatggttaggaagctcaccaagttgttgttagccggtcgtctccgttcctgttacaaaccttcttctgaactccaactctccgatctcctccatttcgtgcattctcttcaagacatgcccatagccatcaagactgatgaaccgaagtcccagcattatgagttacccacctcttttttccagttggtacttggacaaaatatgaaatacagttgctgttactatcttgacaaatcaaatacgttagaggatgctgagaaagctatgttggaactatattgcgagagggcacagataaaagatggtcacaccgttcttgatattggatgtggctggggatcccttgctttgtttattgcacagaaatttaacaactgcaagatcacaggaatatgcaattcaacgacgcagaaaggatacatagaggagcaatgcaggcatcggcagctgcagaatgtggagattattgttgcagatataaccacattcgagatggaggcttcctttgatcgaatattttccattgagatgtttgagcatatgaagaactataaagagcttctaaagaagatatccaagtggatgaagcaggatagtctccttttcgtccatcatttctgccataaagcattcgcctaccactttgaggacacaagtgatgatgactggatcaccagatacttctttactggcgggacaatgcctgctgcaaacctgcttctttatttccaggacgacgtttctgttgttaaccattggcttgtaaatggaaaacattattcactcacaagtgaagaatggcttcagagaatggaccagaacatggagactataaagccaataatggtgttgacctatggcaaagattcagctgtcaagtggactgcctattggcgaacattcttcatttcagttgcagagctatttggatataataatggagaagaatggcttgttacacatttcctattcacgaaaaagtaggccttttatttcatctcactctatcaatgcatcttatgttcagttggatggtagagttacaaaaattcataggggtggaactttatgaaggaaaccattacaatgattgtacggtatatatgcatttctcagtggtgcatgcatattgtctgtaggagtttatttctaagtaacactgcaaaataccgtagcatta

SEQ ID NO: 481 - DNA, 1372 bp, Mahonia aquifolium
cacgttttccaaattaccataaccatttcagagcaccaaattcttaaaaatagaaatattaaaaaaataaaatctatctcaacaacgatattgagagaagtaccttgcacataagacgatcccacactattagsataggcacactcggacagttgacaagcttattagacatattatgacttcttattaaagcaaactacttgagtacatgaaatgccagagctaaatcatttcttcttgaggaggaggtgagttgtcatccattcctcgccattcttacatccgaacatctccattcctgaaaagcagaaacctctccaatagttcaagtactttgttgcagcttctttgttgcccaagaatgattcaaaaattgcttttactgtatccagatttgcgtcgattctcttcaaccaagtctcacagctacgcgaaaaatgtttcccactaagagtccaatgttttacaacagaaacatcatcctggaaatacagaaagaaagaagctgatggtatgagcatagtaccagcagggaaaacaaaagtggtgaaccagtcttcttcatctataggctcgtagtgataagcaaawgtcttgtggcatatgtgctcaatgaaaagaaatccatcttccgatatccatttggatatcttccttaaaagtagttcataattcttcatgtgctcaaacaattcaatgaccacgatgcggtcgtaagtgtcatttgtctcgtgctttgttatgtctgcgaggagaacctccacgtttgacaaattactcttcttagcctcatcctctatgaattctttttgtgagacagaattggtaatggcagtaacacgacagtttttatatttttgagctacatgtaatgtgaaggctccctgaccacaccctagatcaagaacactgtgaccatcctgaatttgagccctctcacagtacaaatccaacattgctatctcggcctcgtctagtgtggtggaatcatctttgaagtagctgcagcttcctttgagcctggcgccattcatgatccttagaaaggagatggggacctcatacatttgggaatccagggtgtctacttcatccgcgattttcattttgcgcagagaatgagccaagtcgagaagttgagcaatttgttgttcataagtgggcttgtaaccccatctcaaacgcctttccaattgagccctgatgagctgcttgatttcatgatcaggtattgacccattctcccacttcttcagcagttcatccttatgctgctcctgctgcttcgtatcatcacaagtagtagttgtattgttgtaattagtttcagcttccacggcagccatgattaacaatctaaagaaagaaagag

SEQ ID NO: 482 - DNA, 1292 bp, Mahonia aquifolium
gaaactaatgggatcaaaggaggaatgaagaaggcagaaatggtgaaaagattggaggatgggttgattccagatgaggaaatcaagaagctcatcaaggttgaactcaaaaggagacttgaattgggatacaaacccacccatgaacaacaacttgctcaacttcttcactttgctcattctttgcgaaaaatggaaattgcaaacgagatagaggctttggattcccatgtgtatgagataccagtctcctttcttgaaattttccatggcccagccctaaaacaaagctcctgctacttcaaagatgaatcaatgacactggaacaagcagagatagcaatgttggatttgtactgtgagagagccgagattcaggatggcatgagtgtgctggatttaggatgcggtctcggatcccttgcgttacacattgctcaaaagtgcaaaaattgtcgcgttactgcaactaccaattccatgtcacaaaaacaatacattgagaatcgatgcaaatcacatcatttgtcaaatgtggaggttatactggcagacgtagcaacacaaaacatggatgacacttttgatcgtataatggtcgttggattgtttgagcacatgaaaaattacgaacttcttctaaggaagatgtccaaatggctatcacaagatgggcttcttttcgtcgaccatgcatgccacaaggcctttgtttctcactttcagcctcttgatgatgatgattggttcacggaatacgtcttccctgccgagacatttattataccatcggcctctttcctactgtattttcaggatgatgtttcagttgtgaaccattggattcttagtggaaagcatttttcacgaagccacgaagagtggttgaagaaattggatacagaggttgacgctgtgaaacttttatttaagtcatttctagagagtgaggaagctgtaacgaagttgattaactactggagaggtttctgctttttcggaatggaactttttgcatataacaatggcgaagaatggatgagttctcatgttctcttcaagaaaaatgaataaacatgcatgggaagacagwctttgatggggagatggaagtaggagcagagaatggatgcaagtgtggagacaactgcacctgcaatccatgcaaatgcggtaaatgagatagacagagatcacttgtccgcgtcgtcatctctctagtaatttatgcataaaactatgtaatatgtgtaatggtgtcttgagtctctatgtatagttgaagcttttaa

SEQ ID NO: 483 - DNA, 1596 bp, Mahonia aquifolium
aatccaatcaatgcccctgcacattaaccataccaaaattggtaacaaaatgccatccaactcataatttttctctaaatttcatcaattctatacaatgataaagtttgatgaatgttgaaggggaaaattatttacattgcattaaaaagactattattacaactaaaatttcaaaactgtctcagcaaaccagaaactcatcaccaaaattaaacatatcatcaaaatcgacagacaccatgtaatcatcaatattatccaaactatgcgaactcgatgtgcacgaaatcacgtccccacggtcacagcccgatgcaaacatcgacgcaggcccggataccgtaaatgtggtaagatcgggggatacgaaatagtcsgacgacgtcgatgcatggtcatggggtaattcagttggtactcatcttggtgctcgtgtttgatggttgcgaakkagtgaagaggatggagcttggtcttgttccagaaaaggagattagaaggttaatgaggattcagatacaaaaacgtctcgaatggggttataaacctactcatgaagaacaactagctcatctcaccaagttcatccagaatataagaggcatgaaaatggctgatgaaattgatgctttagatgctaagatgtacgaaataccgcttcccttccttcaaactatatgcgggaaaaccttaaagttcagtccagggtatttcaaagatgaatcgacgaccttggatgaatctgaaactcttatgatggatctatactgcgagagggcacaagtcaaagatggtcaaagcatccttgaccttgggtgtggccatggaggttttgttttacacctagcccagaagtatagaaactctatagttactggagtcaccaactcagtatctgaaacagagtacataaaggagcagtgcaagaagcttggtctgtcaaatgttgaaatcatcattgcagatgtaacaaaatttgaaccagaggttacctatgatcgcgtttttgcaattgcactcattgagcacatgaaaaattatgcattggttcttaacaagatatcaaaatgggtggcacaagatggatatcttttcgtagagcatcattgccataaagtattcccttacaaatatgagccactcgatgaggatgattggtacactaactacattttcccaggtggaactttgattttaccatcagcctcgattcttttatacttccaggaagatgttacggttttaaatcattggagtctcagcggaaaacatccttcccgtggcttcattgagtggttgaagagattagatgagaacattgatgtcataatgggcatattcgagccattctatggtagcaaagaagaagcaacaaagtggattaattactggagagtcttttgcataacacattcagagatgtatgcatatggcaatggtgaagaatggatgctttctcaagttcttctcaagagaaagtgactcttctttcattttacataataatcgtcttctaaataatgtttttacattttcgcagtaatgtattttgtttctatatgagaaaattgaatttctacaataaatattttc

SEQ ID NO: 484 - DNA, 1321 bp, Mahonia aquifolium
gggattcacaaacacaagcartttasttwgctcataaactcatcaagttcatggataaagctaatgagcgtgaattgaaaagagcagagttgttcaaaaaattagaggacgatttggttacatatgatgaaatcaagcaggtcatgaggactgaacttgcaaagcgacttgaatggggttataaacctacccatcaacaacaacttgcccatctcctcgactttgcccatgccctggaaggaatgaaaatagcaaatgaagtagaaactctagcgtctgaagtgtacgaaacacccttrccttttwtagagatcgtccttggtcctgctaaaaaacwaagttcttgcttgttcgaagatgaatcaacaacgctagagcaggctgagatagcgatgttggacttgtactttgaaagggctcaaattagaratggaatgagtgttctggatttgggttgcggctrsggatccgtrggtctacatattgctcgaaagtacaaaaattgtcrtgttacctgtattaccaattccatctcacagaaacaatacattgaaaatcaatgcaaattatacaatttgtcaaatgtgaagatcatactggcagacatagtggcacacgatacagatgatactttcgatgtcgtcttggtcatcggagttattgagcacatgaagaattacgccttacttctaaataagatatcgaaatggatggcaaaagatgggctgctcttcgtcgaacatttatgccacaagacttttccttatcactttgagcctctggacgaagatgactggtactcaaactttgttttccctacgggaactttaaccatgccatcagtttctttcctwctctatttccaggccgatgtttctattctaaaccattggatcctctcggggaagaatttttcacgtacctwtgaagagtttttgaagagaatagatgcaaatgttgatgcaataaaagatgggttgaagccatctttgggcagtgaaggtgttgcgaagttgattagctattggaggggattttgcttgactggaatggaaatgtttggatataacaatggagaagaatggatggtttctcaggttctcttcaaaaacaaatgattatttgtccaagtaatgctaagggtcctcagcttaggaggttgccgatgcaaaacttattaccagtgtttagtgaatttcatgtttcatagaagtacaagtgttcggttgttgattagattgtagttatattggcctgggaggttatgtaaccttcaagataacatgattgtaataaataaataaawaataryawwaatggc

SEQ ID NO: 485 - DNA, 1481 bp, Menispermum canadense
ggttgtaatagtctctcacatcagacgtgtgatagaagcaagactgagctatattgtactatccctttcaatcactattgacgttttttttctctgagagggaacaaaaccttggtagccgagacaatatcgggtggggtagaacgggatgagaattttgtaggtagtgtccatcaaaaacatcagctttttattgaatcccaactataacaaattagtttcaaatggacgatggagtgacaatttattttgtagattggtgaatagttttaagatctcattgtccaagaaaaataatgaattgcagagttgcatcatttcttcttgaagaggacatgagatgccatccattcttcaccatttttgtacttgtagagctccatcccagataagttgaatcctctccagtagttcatcagcttcaccgcagcctcctcgctgcctgtgaaggattccattattgctttcactgcatcttcattggcatcaatgttcttcagccacgcttcatgggtacgagaataatgccttccgcttagcgtccaatggttcacaaccgaaacatcatcctgaaaatatagaaaaaaattggctgatggtatgatcatagtcccagccggaaagatgtattctgtgaaccagtcatcttcatcaagaggctcatagtgatagggaaaagttttgtggcaaatatgctcaatgaaaagaagcccatctggtgtcatccattctgatatcttcctaagaagcagctcatagttcttcatgtgctcaaacaattcaataactaatatccgatcgaatctatcatccattttgtgcgtggttatgtctgctagtacgatctccacattcggcaagttgtttatcttgcattgctcttcaatgaactctttctgagccacagagttggtgactcctgtgacccgacagttgcgaaacttgcgagcgacgtgcatggtgagagcaccttggccgcacccgagatcgagcactcgctgaccatctttgatctgtgacctctcgcagtacaaatccaacattgctatctcagcctcatctaatgtcacagtgtcatctttgaagtaacagcaacttcctttgattgtgtttccgaacataagctttaaaaatgagatcggcacctcgtacatttgggagtccaatgtatcgatctctgttgcaatgctcatcttacgtagggaacgagcgaaattgacgacatcggcagtttgctgttcataagttggcttgtaaccccatcgaaggcgcctctccagctccacctttatcagccgtctgatctcatcatacggaaccagacccagctctagcttcttcagcagctccgccactcttgccttcttatcttccatatctcctgatcccacagccattaaaccaccacacacaattaatacaagaaacagagactcaagtgatcagttccaagcaaccaattaggctttcaacggttggtt

SEQ ID NO: 486 - DNA, 1360 bp, Menispermum canadense
aacttgaattaggaaccttccattatatttataacgaaagaagagatcctttgtctttctctcagagagccagggtagggaatatggctagtgttgatggtaaagctttgaagccaaaaaaggcagagattgtagagctgttgaagaagctggagcttggtgttgttccagatgaagagattaaacaccttgtaaggattcaattggaaaggcgtcttgaatggggctacaaatccacctatgaacaacaaatctctcatgtcctcaacttggtccactctctacgtcaaatgagcataatgacagaggaggtcgaaacatttgattcagagttttatgaattgccaatatctttttggaagattaaactaggacgagcaatgaagcaaagttgttgctacttcaaagatgagttgacaacactagatgaagctgaggaagcaatgctagagttatactgcgagagggcacagatagaagatggccaacgagtgctcgatcttgggtgtggatatggatctcttactttgtacattgctcgaaaatatccaaattgtcacgttacaggactcactaactcaatctcccaaaaacagttcattgaggagcaatgcaaggacagtaatttatcgaatgtgaacatcatattagtagatgttgccacacatgaaacggatgagacgtttgatcgaataatggttgtcggattgctcgagcacatgaagaactgagttatttcttaggaagttattgaaatggatgaaacaagatgggtttcttttcattgatcacgtgtgccacaaggccttagcatatatttacgagcctgttgatgaagatgattggcttccagaatgcacctttccatctgggactatagtcattccatcagcccactttctactctactttcaggatgatgcttccgttgtaaaccattggattattaatggaaagaattatcgtcgaacaagcgaagagtggttgaagagaattgatgctaatgcaaatgccttgaaagcaataatgggatccgtatcaaggaaagaggatgaagctgttagattgactaactattggagaaccttgctcttgtttcatatagagcttttcaaatacaacaacggcgaagaatggatggtagcccatattctcttcaagaaaaagtgatgcaataagtatacaagtattctctttgaaaaaataaatagcattgcactgtcctttcttcatgaataagatgtactctggaattactggaattgtgtcgatatatatatttatatgcatatatatggtattactttgacaaaaaaaacatttttcattttgtaattctccttatataccaaaatctgaa

SEQ ID NO: 487 - DNA, 1333 bp, Menispermum canadense
cagtccatcactcccctttcaattctctctttcatatatgtgaatctatagcagattaagttgcaatggctgaggaagcaaagagcgcaatagaagtagtggagctgctgaagaaggtggagcttgggctaatcccagatgatgagatgaaaagcttcataaggattgaattggagaggcgacttcaatggggctacaagcctacccatcaccaacagctctctcaagtcctcaactttgctgactctctgcgtggaatggacatcgccatggacgtgtcctcggtggattggcagttgtacaacgcacccatttccttcttgaacatcatacatggacgcatcattaaagaaagttgctgctactttgaagatgatagtgttacagtagaggaggctgcggtggcaatgatggatttgtattgtgagagggctaagattgaagatgggcagagagtgcttgatcttgggtgtggcctaggagctcttacaatgcacattgctggcaagtacaacaactgtcgtgttactgggatcactacttctccatcacagaaacaattcattgaagaccagtgcctgaagcacaatttgttgaatgtggagatcatattagctgatgttatcacactcgaaatggaccaaacatttgatcggatactggctattgaattgttcgagcacatgaagaactatgagctacttctcaggaagatatcaaaatggatgacgtcagatggctttctttttgttgagcacctgtgtcataaagcttttccttgccacttcgagccacttgatgagacggattggatcacaaattacgcctttcctgctgggaccataaccatgccatcagcccactttcttttatattttcaggatgatgtctccattgcgaaccattggactattagcggaaaccattgttcgcgcacacatgaagagttgttgaagagaatggatgagaaagcaaatgcggtagaagcaataatagagtcattcttgggcagcaaagagagtgcaagaaagtggattagctattgcagagttcttcacttactttctatagagctattcaagtacaataatggtgaagagtggatgatatctcatgttcttttcaaaaggaaaacagtgcattcaaatatgtagctacaatatttggaatttcagtatgaaggcatccttcaagttatgaaacttgaataagcaagtaaaataatcctactttatccatgtatcaactttgtaattttgatttttattgatgataaatgcatgcatttatctctttaatctctttgtttgattttattttaggaagcttttat

SEQ ID NO: 488 - DNA, 1482 bp, Menispermum canadense
gatcggggggagtcgtggcagacgcttaaagcgcatcgctttgtttgccatcagcctctgctgcagactcaacactacacacagcagcctctgcatatataatctctgtgtgtgagcctcaattaatagtcccaattcagattcatctcagcttctttaatttctttcttgcttgcttgcttgcttgattagtataattaggtagtgaggctatggatgctaaggaggctaagaaggaaagttgtgttgcagagctgctagagagaccggagcttgggcttgtaccagacgaagagatcagaaagctcacgaggactcagcttgaaaagcgtctcagatggggttacaaagccacccatgaagaccaactctctcaccttcttcaattcatccaatgtctaccatctttaaacatggaaagtgagggtgataaaccaaaatcttggttgtatgagacaccaacttcatttcttcagcttatctatggagacaccatcaaagaaagtagcacatactacaaggatgagtggtccacattggaagaggctataacacacatcttggatttgtgctgtgagagggcaaagatacaagagggccaaagaattcttgatcttgggtgtggttatggagcactcactgtacatgttgcaaacaagtacaagagttgcagtgtcacaggtgttactacctcaatctctcaaaaacagtacatcacggaacagtgcaaaaaactcaatttatctaatgttgaggtgatattagaggatgtagcaacaatgaaaatggagacaacatttgatcgaatatttgctctgggaatatttgagcatatgaatgactacaaactatttcttggaagaatttcaaaatggatgaagcaagatggtcttctctttgtggaatatttgtgcaacaagacctttgcataccaaaataagccacttgatgacggtgatgattggtacaatgagtatgttttcccatctggtggtttgattataccatcttcatcgtttttattatacttccaggatgatgtttcaatcctaaatcattggacttttagcggaaagcattcagcgcgtacctttgagaagctgttgaagagaatagatagcaaaatcgatgcaatacaagagatattcaatgaatgttacggaagcaaggaagatgcaataaaatacataaactactggagagtgttcctcattacaggagcagagatgttttcatacaatgatggggaagaatggatgggttctcatttcctcttcaagaaaaagtgatgagatggacttagttcattattataaataatgtatgttggatttagtttaattacaagttacttgatggcaaccatgttgttcagtcacaatcatcaagctcaattaggaagttggcattccatgcaattctctattataaaataaagtgagaaatgttgaatagattttgtttattttatggatatttgaa

SEQ ID NO: 489 - DNA, 1366 bp, Nandina domestica
agtccaaacttctaaaatatggtttaacaaatattacaagtaataaatatacagatgtaccaaacacaaccataataaaagtcaacacaagtccaataatccaattaaatacgttttattaatgtttattgaggaaatacaaaataagcaactaaagagcattacttcttaaggagaagatgagatgtcatccattcttcaccattgttatatccaaacatggttattccagataagcaaaaacctctccagtagttgataaacttcattgcagcttcttcactacccaatgattcttcaaaaattgcttttacagtatcaacatttgcatctaaccttttcaaccattcttcattggtacgggaaaaatgctttccactaagtgtccaatggtttataactgaaaggtcatcctggaaatacagaaagaaagaagctgatggtataatcatagtaccagcagggaaaacataatccgtaaaccaatcatcttcatcaagaggctcatagtgataagcaaaagtcttgtggcatatatgctcaatgaaaagaaacccgtcttgtgacatccattgtgatatcttcctcagaagaagttcgtagttcttcatatgctcaaacaattcaatgaccattatgcggtcgaatgtgtcatttgtctcatgttttgttatgtcggcgagtatgacctccacatttaacagattattatacttgcattggtcctcaatgtattttttttgtgagatggaattggtgatggctgtaacacggcattttttgtacttttgagcaacatgtaaagtgagagctccttgaccgcaaccaagatctaaaacactctgaccatctttaatttgggctctctcacaatataagtctagcattgccacctcagcctcgtctagggttgttgaatcatctctaaagtaggaacaacttcctttaagcctggaaccattcatgatccttaaaaaggagattggcacctcgtacatttgagaatccaatgtctccacttcatccgcaatcttcatttttcgcagggaatgagccaaattaaggagttgagcaagttgttcttggtgcgtaggcttataaccccatcgaagacgcctttccatctctatacccattagtctcttgatttcatcataaggaaccaaaccaagctccaactttttaattagctctgccttgttcttgttgctaattactgttttatcactgttaccatcttccattactgccatgatcgcacaagcaggccaggcagatgtttcttcaacaatggactgaggatgatttcaattcataaaatgtctatttctccaaaacgaaataaaagaatttatgaattgaaatc

SEQ ID NO: 490 - DNA, 1042 bp, Nandina domestica
tgaaatcatccattcttctccattattgtaggagaattgttccatcattgctagatgaaagttcctaaaatggttaatacatctctctgcagcttctttgctgcccaaggcaattggtagtatgtctctggcaacatccatattcttcacgagatttttcagccacttttcatgggttcgagccatattctttccatttactatccagtgatccataaccttaacatcatcctggaaataaagaagcgttgaagctgcatgtattgtaaccgaacccttggggaaaatatactctgagtaccaatcctcctcgtcaagtcccacgaagtgttcggggaatattttgtggcacacgtgatctacaaagagaataccatctgctttcatccacttggatattttgtttagaaatagtcgaacatttttcatgtgctcaagcgcttcaataatgagtactcgatcgaatgtgtcctccatttcatatttagttacatcagctaatataacctttatgtttgacaatttcaaattcctgcattgctcttctataaaattcttttgcacaaatgagttagtaatgcccgtcactagacaatttctgtaccttttagcaatgtgaaaaataagacttccctgaccacatccaatatcaagaattcttaggccatcttttaacattgctcgttcacaatgtaaatcattcattgctatctccgcatcatcaattgtcattgactcgtttttgaagtagcaagcactttgtttgagagtctttccgaacactgttttcaggaatgaaattggtaactcataggactctgaatttataatctccatgtctccagatatatccatttgagtcaaagatttgatgaagtgaaggtgaaaagcaagctgttgttgattagaaggcttatatccccattgcagacgcttttgtaactgtaaatgcactagcttcttcagttcttcctcggaaaccaatcctccatccaacttctccaatatctcttctttttttgggcgatgcagctttgatgac

SEQ ID NO: 491 - DNA, 1479 bp, Nandina domestica
gtcgcgatgatggttacttgacgagccaagcttgggaaggttgtttgcttggcgtgaagatgatgggtagggttgatattgcaatgactgtaaaactggttttaaacatgtagagacatatccctaaattgaagggacggaagtatatgcgcttcagttcgtgtggataaagtgattactcccttcttcttcttcttttgtctgcaattattagacagaaagaaagcatagatggaatcagtgacaaaggtaccatataatgctagtgtgcgcatgatgctaagtttgcttgagcgtaacctattaccagacaccatagtaaggaggctgacgaggttgttgttagctgctcgtcttcgtttgggctacaaaccttcatctgatcttcagctttccgaccttctccacttcctacattctcttcaagatatgcctatagctatcaagacggataaaccgaaggcccaacattatgagttacccacttctttcttccagctagtacttggaaaaaatatgaaatacagttgttgttactttcttcacaaatcagacaccttagaggatgctgagaaagctatgttgaacctctactgtgagagagcagagataaaagatggtcacactgtccttgatgttggatgtggctggggatccctctgtttatttattgcacagaaatatagaaactgccagatcacaggaatttgtaattcattgacgcagaaagcatacatagaggaacaatgccggcacttgcagctgcagaatgtggagattattgttgcagatatgtccacatttgagatggatgcttcttttgatcggattctttccattgaaatgtttgagcacatgaagaactataaagagcttcttaagaagatatccaagtggatgaagcaggatagcctccttttcgtccatcacttctgccacaaagcatttgcctaccactttgaggataccagtgaagatgactggatcacgagatacttctttactggagggacaatgccttctgcgaacctgcttctgtacttccaggaagatgtttctgtcgtcaaccattggcttgtaaatggaaagcattacgcacttacaagtgaagaatggcttaagagaatggacaagaacttggggacgataaagccaataatggagttgacttatggtagagattcggctgtcaagtggattgcctattggcggacattcttcatctctgtggcagagctgttcggatataacaatggagatgaatggatggttactcatttcctattcaggaaaaagtagaggtgtctgactcttaaaatgtttttctttccttcctttcgtttcacttctcaccacgcatctaaagtgttctctctcgaggaaaacaattggatgagagctataaaaattcgaagcactcatggcttgtggtattaatgtatgttcaagtaatatcctttttatataggtcattttgaa

SEQ ID NO: 492 - DNA, 1522 bp, Nigella sativa
atgatacatatataggagctgttactgcccccaatatagcttaactaaagggaccatcacaacaaatgcttacagagactgttacaatcaaatgattaaactgaaaagtgtttcacagagcaaaaagattaaactgaaaatcatatattagccaataaccaattgagttttgtacattgttctctttctctgtgtgcttgaaacctattgttccgctttggaacttccttgtgaattcgcccaggaaatttcatttttatatattctgttattcagtgccacttactggaaacatcaaccatccttattctcgtgacatgataaagaaatacagacatttgttacaaattattttctcttgaacaaaacatgacttgccatccattcttccccatctttgtatccaaacatttccattccagataaacagaaacctcgccagtaatttataagcttcatggcttcttccttgctgcccgttaaagcctcgaacattggctttataacatcaaggttggcgtctattctgttaaaccattctccattggtccttgagaaatgtttcccactaagtgtccaatgattcacaactgaaacatcatcctggaaatatagaaagaaggaggctgatggtatgatcatagtcccagcaggaaaaacatattcagtgaaccaatcatcttcatctaaaggctcatagtgataagcaaaagttttatggcaaatgtgttcaacaaagagaagtccatcttttgccatccattttgatatttttctaagaagaagttcatagttcttcatgtgctcgaatagttcaattatcaatatacgatcatacttatgagccatctcatgtgtggtaatgtcagccaaaacaacttccacattagttaagccccctttctttgattcctcttctatgtactctttttgtgaaactgagtttgtcacggccgtaacgcggcaattcttatacttttgtgcaaaatacaaagtaagagctccttgtccacatccgagatcaagaacactttgtccatcttttatttgtgctctttcgcaatataactccaacattgctacttcagcttcgtctaaggatgtcgaatcattctcaaagtagcaacaacttccttttagtctgcttccattgatgatctttaagaactcgataggcacctcatagagttgagaatctaatgtgtcaacttcgtgagcaatgctcatatgtcgaagggagtgagctaattggagaagatgagctagttgttgttcataagtaggcttgtaaccccattgaaggcgcttttccaattccactctcattagccttttgatctcatcatatggaaccaacccttgttctaacttcttcaacaactctgctatgttggctttctttgcttgcttcctttcaacttccatttcaagaacaaacaaagagaattagttggtttggtaggtaagttagaaaggaagcaagcaaagaaagccaacatagcagagttgttgaagaagttag

SEQ ID NO: 493 - DNA, 1223 bp, Nigella sativa
ttgtgatgaaatctatgtagttggggaaggtgagacgcttcacacaggcccggattgtcatcttaacaaaccaaccttgtttttcttcttctattccatggggtcagagcaaaccaagaaggaatcagttgcagagctattggagagactagacaggggagttgttcctgatgaagagtttatagagcttgtcaagattcaattagacaaacgtttgcagtggggttacaaacctaccgccgaagaacaagtggcttcatatcggctttatagatgctttgaagaaaatggaaatatctggagatatggaaaagatcaactctgaatgctatgaggttccaatttcatatcacagtctagtatttggagcagctctcaagcaaagtgcctgttacttcaagcatgattccatgacgattgacgaagctgagatagcaatgcatgacttgtactgtgaacgctcacaaataaaagacgggcaaaagattcttgagattggatgtggccaaggaggtcttcttttccatattgctcataagttcaaaaactgcaatgtaaccggagttacaaactcaattagtcaaaaggagttcatagaagagaaatgcaggaaacttgaagtgcaaaacatagaggtaatattagcagatataacaaaatatgagacagaagatggatttgatcgaatactcatcattggaactgttgagcacatgaaaaatgttcaattatttctaaagaaggtttccaagtggatgaaagacgatggatttctatttgtcgatcatgtttgccacaaattatttgctgagcaatttgaggcacttgattctgatgattggtatgcggaaagccttttccctaaagggtcagttattatacatgcagcttcgacacttctctattttcaggatgatatttctgttgcaaatcactgggttttaaatggaaagcatatggcttactcacatgaaaggtggctgaagaatttactcaacaatcgtgatgctgcaagagaagtgctgcaactttcgctaggtagtgaagaagctgcagagaaatttatcaatcactgtcggatgtttcatcttgccatgaaggaacagttttcatataataatggagaagaatggatggtttcacatcttctctttggaagaaaatgaagtatcttttgatgtttttactataattgcatagttgtaataagaggtcaagcaggt

SEQ ID NO: 494 - DNA, 1474 bp, Nigella sativa
gctttcttattttattaatacgcaaaactgttatcaatacaatctcaaaacatcatttattaggtcatcttaatacattatcactcatgaagttctttgtgattggtatctctacccttttcttattttgcctcatatattattacactattccttaatgtgtattactgcaacatgttcactttctcttgaagaggacttgtgaaagcatccattcttcaccaccattggttgcatacatctctgagtgggcaatacaaaaaactctccaataagtgataaattttgtagctttttccttgcttccatagaatgattcaaatatctccttaatttcatcaatgttatcatctatccgcttcaaccactgtttgaagccaagtgatggatgttttccactaagagtccaatggttcacaactgagacatcttcctgaaaatacagaagaattgaggaggatgacataaccaaagttccagttgggaagatgtactccgtataccaatcatcatcatctataggctcatatttataggcgaagactttgtggcaatgatgctcaacaaaaagaagcccatcttgtgccatccatgcggaaactttcttcaaaaatagttcatagtttttcatgtgctcaattaaggcaactgcaaatatacgatcataagtggtccctgtttcaaacttggttacatcttctaatatgatttcaacatttgatagattaagtttcttgcattcttccataatgaaatccttttgtgatacagaattggtgatcccagtcactttacaacctctatacttttttgcaacatgtaaagtaagagagccatgtccacaaccaagatctagaatagtttgaccatcttcaatttgcgccctctcgcaatataggtctaacatattaacttcagactcatctaacgttgttgattcatccttgaagtacccggggctgaatttgagggcctttccacacatgatatgaaggaaaggaagaggtatctcgtacagctctgaatctaaagtatctacctcctctgccatttccatcttttgaagagagtgaacaaagtgaaggagttgagcgagttgttgttcatgagtggacttgtaacccagcttgaggcgtttctgtatctgaatcttcatcatcctggtgatctcttcatctggaacttgtccattctcaatccgcttgattagctctgcaacaccttgtttctttgttatctgagtagcctccatgactttgagtactgagagagatgttatcttgttattaagaagttgggggtacgagaggagtagtctgataagtttcagttgttgaagtggggtttaattactttaatatatagtggcatcatcttcttcaagtctggatgattggatggacaaggattgattcctgaggacactaagaaaccaacaaaaatagatttcgattttctgcggatggggtgtccg

SEQ ID NO: 495 - DNA, 1227 bp, Nigella sativa
attgctagatggaaggattatttgattctttgaaataaacattattcaaataatataaaagtggattaactaacttaaacaaaaaaatataactaaacaaacataatgaaaatttgatctaatatgtctaattcttcttgaataaataatgtgcaatcatccattcttctccattcttgtatccaaatagttctcccataaatatcaaatatgttctccagtatacagtccacttgatcgccaaatccttaccataaagacttcgcattataggttccatagcacttgaattcttgtcaactttcttaagccactcattacatgtcttcgaaaagtgttttccattaacaatccaatgatccttgacagatacattttcctggaagtataaaagcaagtttgcagatggaaatgttcctcccgtgaagaaataccttccataccattcgtgtgcatgggattctaaaagagaaatatctttttcttcattcgtcccctcaaagctgtaagaaaatgatttgtgacaacagtgttcaacgaaaaggagactgtcatctttcatccacttcgctatcttcttaagaagcgccttatagtttctcatgtgctcaaacatttctatggaaaatacccgatcaaaagtggcttccatctcatacgtgcttatatcagcatgaataatctccacattatccaacatccgatccctgcaaatttgttctatgtatgctttctgtgtagtggaataagaaagcccagtgatcttgcagtttttatatctttgagcaatatataaacacaaagatcccaaaccacatccaagatcaagaatagtgtgaccatctttgatctgtgctctttcacaataaagctccaacattgcttcctcggcatcatctaagggtgttgactcatccgcaaaataactacaactaaatttggcttgcttcccaaaagccaacagaaaaagttcagtgggtgcttcatattgttgggagtttggtttatcagacacagcggctataggcattttctccagagaacgcgcaaagttgagttcatcagagagttgttgttggaatgtaggtttacaggcatctctaagccaagacgataatgaggaactgattcgcttccttagtatcacatcggggattaagttagcttcgtgtaaagattgcagtatacccattgctgcaaatcaatctctctctctctctctctctc

SEQ ID NO: 496 - DNA, 1522 bp, Nigella sativa
tatgtcatggatcgactaagttttagacaacataaatcaaattttatccagggtataatgggaataccagatatgtgaataccaaatataatagaatattagcattgatatagacacaaatgcaaggttcccctgcagtctttgtaatctttatttttagtttcaatgcctaaatcatccgattaaagaaagtctcactgaagtgaacaaaatattagaagctaaaaagaaaaaagaaaaaggatctggacaggtgatcgtttacttctttttgaataggaaatgcaccaccatccattcctcaccattgttatatccaaacagctcagccacagagatgaagaatgttcgccagtaggcagtccacttgagagccaaatctttgccataagttgttaccattataggttttatggtagccaactccttgtccattctctttagccactcttcgcttgtctgagcataatgttttccattgacaagccactgattgacaacagaaacatcttcttggaagtacaatagtaagtttgcagaaggcattgtccctcctgtgaagaagtatcgggtaatccagtcatcttcacttgtatcctcaaagtggtaggcgaatgatttgtggcagaagtgatgaacaaagaggagactatccgatttcatccacttagatatcttcttgagaagctccttataatttttcatatgttcaaacatttctatggaaaagactctatcaaaagaggcatccatctcataggtgctaatatcagcaacaataatctcaacattttgcaacttgcggtccctgcactgttcgtctatgtatgctttctgcgttgttgaattacaaatccctgtaaccttacagttactatatctctgcgcaataaataaagctagtgagccccaaccacatccaacgtcaaggacagtatgaccatcttttatctgcgccctctcacagtacagatccaacattgctttctctgcctcctctaaggtgtttgaattgtccagaaaataacaacagctatatttcatatgttttccaagcacgaggttgaaaaatgaggtgggcaactcgtaatgttgggcttttggttcatcggtcttgattgctataggcatatcctgaagagagtgtgcaaattggagaagatcagagagttgctcctcagtagaaggtttataaccactgcgaagacgagcagataacaacagccttgtcaatttcctcactactgcgtctggaagtagattacgttctagtgaagatagcataacgcggactgtagcattgtaaggtgcttgaaccaatccatctatcatggtcatggcggcggctatacacaactctgtcaaagatgcaggaatgaaatgaactaagtaatcttctttcactctttccccttttcaagaaaaaacctctaccacgatcccttgcagatgcagtccatcttgtccttttcctttgggggtgtaagttgattgagtgagagaggatgtactaataaggttg

SEQ ID NO: 497 - DNA, 1595 bp, Nigella sativa
ctgaaaaaatgttctatccccaaacttcttatacaaggtattttgagtaaatatcccttaactcggattaaactaaataagagtagctcaaaatgtgaaaataaaataaacatcatgatattgagacaagtgatatttatttctttttgaataaaacatgtgtgatcatccactcttctccattgttgaatccatacatttcttgcagaaatagtaggaatgatctccaataggcagtccacttgatagtagaatcttcaccataaactctttgtatcataggtttaatattacctaagttattgtccattctcttaagccattccttacatgttcttgcaaaatggttcccactaacaatccattggtccacgatcgaaacatcttcctggaagtataaaagtgtgtttgcagaaggtaatgttcctcctgtgaagaaataccttccaacccattcacgggcattagtctctgaaagagaaatgtttgtttctttatttgtttcctcaaagtagtaggaaaatgctttatggccgcagtgatggacaaaaagaagaccatcttctttcatccactttgatatcatcttgagaagtgccttgtagtttctcatatcctccaacaactctacagcgaatatccgatcgaaagtggcttccgtctcatatgtgcatatatctgcaaaaacaatctccacattgtccaacattcggtccctgcatagttggtctacgtaagctttctgcgttttagaataactgatcccggtgattttgcaattcttatatttctgagctatatatagacataaagatccccagccgcaaccaagatcaaggatagtatgaccatctttgatttgtgccctttcacagtaaagctccaacattgcttcctcagcgtcgtctaaggtggccgagttatcaacaaaatagttacaactatatttcaaatacttccccagcatcagctcgaaaaactctgtaggcaactcatattgttgggaatttgcttcatcagccacagttgacataggcatactttcaagagaatgagcaaagctgaggagatcagagatttgtgcttgataggaaggtttgtaacattcattgagccaagcagataaagaggacctcattgcccttctcaataccatatcgggggttctgtttgcttcgtggaaggatagaagcaagcgcgtaatagcattttgtggtgcttgaaccaagtcatgtatacccatggttgcacaaatacttctctctcaaatatctttttgaatgggaaaatttcttgctcgcagagatgtagtagtgtagaagaaaattgttgaggcacttctacttttgcaacacacgtgtcgtaacatgttagtcacaatacagccccctgcatttactgctgagctccctgatcttctgcaactgtgatggtgcgtataagtgcgcgagacagagatcccacaatcaagagattaaagacttgagcactgagttaaagggacagcatccaagtggttgagagttggatttggagagatggggttgagccgcggagcattggagttgaagaagaagaaaggaggagtgaggaga

SEQ ID NO: 498 - DNA, 1300 bp, Papaver bracteatum
tagatatctgcaaaccattatttaataactttaaatggtgaagggtgatcaattccagacgacaaccatggaagaaactaaaattagccaagaaaatgatttgtggacgaatatggagcttggtttaattccagatgaagaggtcagaaggctgatgaagattgagatcgaaaaacgcatcgaatggggcatgaaacctactcaacaccagcaacttgctcaactccttgactttactaaatctcttcgtggcatgaagatggcaacagagctagacaaattagattcaaagctttatgagactccacattcattcaaccaaattgtgaatggaagtaccctcaaagaaagttcgggtttgtacaccgatgtaacgactacgatggatgaggcaagtataaaaatgatggatttatattgcgagagggcaaacataaaggatggccagaccatattagatctaggctgtggacctgggccattggttttgcacatcgcaaagaaatacagtaattgcaagattacaggagttactaatgcattctcacagagagaatacatattagaagagtgcaaaaagctcagtttatcaaatgttgagataatattagcagatgttacatcactcgatttggaaactacatttgaccgtgtttttgttatcgggttcatcgagcacatgaagaactttgaattatttcttcgaaaaatatcaaaatggatgaaagatgatgccgtgcttttcttggagcatttctgtcacaaaagcttttcgtaccatggcgagccattgagcgaagatgattggtacgccaagaactttttcgcaccggggacgttggtaataccatcagcaacatgtcttctgtatttccaggaggacctggcggttatagaccattggttccttagcggaaatcattttgctcgtaccaatgaagaaatgttgaaaggaatagatgggaaaattgaagaaataaaagacattttcatgtcattttatggaattaacgaagccgaggccgtaaagttaatcaattggtggagactattttgcatcactggagctgaaatgttcagttataataacggtgaagaatggtttatctctcaactgctttttaaaaagaaataactcttctttgatcaaaactatcactcaatgtggcttattatgtttaccaaacttttgaataaaacttgacgctagtctttatgccgcatttatttcttttgggagacaatatgaatacaatttgatgtttgttggttgttgtaatatccaattgttgtaatatcc

SEQ ID NO: 499 - DNA, 1215 bp, Papaver bracteatum
ataacatgccacgaatacacaagtggcgcaaagtttattattttatttgtaaataaagagttatttcttcttgaaaagctgagatcaccattattgtatttgaacaactcagatgcaagtcattaacttctttttgaaaagtaattgagagatcaaccattcttcaccattattgtacttgaacaactcatttgcggtgatgcacaatagcctccaccagttgattagctttacagcctcttcttctccaatcccataaaatgacatgaatatatcttttacttcttcaattttactgtctattcttttcaatattgcttcattgctacgagcaaaattatttccgcttagaagccagtggtctttaaccgtcacatcctcctggaaatacaaaagacatgttgctgatggtattactaatgttccggatgggaaaaagtttttggcataccaatcatcctcacttagtggctcccaatggtcggaaaagcttttgtgacataaatgctccaagaaaagcaaaccgtcgtctttcatccattttgatatttttcggagaaatagttcaaagttcttcatgtgctcgatcaatccgatgacgaatacacggtcaaatgttctttcaatatcgactgtggtaacatctgctaatattacctcaacatttgataaattgagattcttgcactgttctagtatgtgttctttgtgccatgatgtattggtaactccggtgatcttgcaattcttatatttctttgcaagatgcagaacaagtagcccagcaccacaccctatatctaatatggtttgaccatcttttaagcctgctctctcacaatataaatccatcatttttgtatttgcctcttctatcgtagtagtcgcttcatccgtaaacaaaccggcgctttctttcccaccgataatctggttgaatgagtccggtatctcataaatcttatggttttctaatgcgtgtacctctgttgccattttcatgccacgaagcgatttattgaagtcaaggagttgagcaagttgttcctgttgagtaggttttgtgccccatttgatacgtttttcggtttcaatcttcatcagccttctgacctcttcatctgaaatcagcccgagctccatattcttccacaaatcatcttgttgactgattttagttgtgtccattgttgtacacattttcttgtttccttg

SEQ ID NO: 500 - DNA, 1349 bp, Papaver bracteatum
cacctctctcaataatttcgcaagtatttcattttgtttctctccctagtttagcctagattgtctcatcatgggttcaatagaagaagtgaggaaggaatcagcagaggaaactctagggagattgttaagaggagagattaatgatgaggaattgaagaaactgattaagtatcaattggagaaacgtcttcaatggggttataaatcatctcatcaagaacaactctccttcaaccttgacttcattaaatccttgaaaaagatggaaatgtcaggagagattgagacaatgaacaaggaaacttatgaattaccctcagaattcttagaggcagtttttggaaaaacggtcaagcaaagtatgtgttacttcaaacatgaatcatcaacaatagacgaagcagaagaagctgcacatgaattatactgtgaacgagcacaaatcaaagatggacaaactgttctcgacattggttgtggtcaaggtggtctagttctatacattgctcagaaatataagaaatgtcatgttacagggctcactaattcaaaggaacaagttaattacatactcaaacaagcagagaagcttggcctgagaaacgtggacgtcatgctggcagatgttactcaatacgaatctgacaagacatacgatcgactacttacgattgaactcatagagcacatgaaaaacatacagctgtttatgaagaaactatcaacttggatgacagaagatagtcttctgtttgtggaacatgtctgccataaaacatttagtcacttttttgaggcaatcgacgaggatgactggtactctggtttcatcttccccccaggttctgttacaatactagctgctaatagtctcctctattttcaggatgaggtttcagtggtggatcattgggtcgttaacggaatgcacactgctcgttcatttgatgcatggagaaagaaggtagacaaaaatatggaagttgcaaaagaaattctattacctggacttggaggaagccacgaagcagtgaatgcagtcgttactcacattagaacattctgtatgggagggtatgaacaattttcactgaacaacggagatgaatggatggttgcacatcttcttttcaagaagaagtaatgaggcacatcccagctgcatttcctgggtgcggcaataatttgatcttattgcaacaacaattgtgggttgtatctcaggggtttagcttgttttcatggtttacaattttacatttctacaatgtttacatctacttcggatctgaagaattcatttattaatgttatcatgtaatggattaacaggtgtgaggaaactg

SEQ ID NO: 501 - DNA, 1318 bp, Papaver bracteatum
gctttactcctttgaactgctgatctgcttactgttcatctttggttttcttcattttcttgttattgaggagcaggaatggagacattaattcaagtaccatacaatgctacagtacgtgtgatgttaagttcactggaaagaaatctattaccagatgttgtcatcaggaaacttactaaattgttgttagcaagtagacttcgtctgggttataaaccttcttctgaaattcagctctctgatcttatccaatttgcacactctcttgaagaaatgccaatcgcaatcaagacggaatcggctaaagaacaacattacgaattgccgacatcttttttcaaattagtgctcggaaaatatatgaaatatagctgctgttacttttctgataagactgcaacgttggaagatgcggaaaaagcaatgctcgagctatactgtgagagagcacagataaaagatggtcatacagttcttgatgtgggctgtggatggggatcgttttctttatacattgcacagaagtataagagttgcaagattacagggatttgcaattcaaagactcaaaaagagcatatagaagaacaatgcagagaacttcagttgcagaatgtggagatcattgtagctgatatcagcacatttgaaatggagggttcttatgatcgaattgtttcaatagagatgtttgagcatatgaagaattataaagagcttcttaagaagatatccaaatggatgaaagaagatagtctccttttcgtgcactacttctgccataaagctttcgcataccactttgaggacacaagtgaagatgactggatcactagatactttttcactggagggacaatgccttctgcaaatctacttctctactttcagggtgatgtttccattgctaaccattggcttgtaaacgggaagcattatgcacaaacaagtgaggagtggctaaaaagaatggacaaaaacataagcactataaagccaataatggagtcaacttatggcaaagattcggctgttaaatggaccgtgtattggcgaacgtttttcatctcagttgctgaactcttcggctataataacggagaagaatggatggttgcacattttctattcaagaagaaatagatagagagatgtgggtgctcttattttcaattgtttttcatttcaaaattttcagacatttcaacgctatatattttgttttcactaaatgcaactgaattgaacctttgtcactcactggttcatcatttccaagtccggtctttctgaaaataagaagggtcaattgcta

SEQ ID NO: 502 - DNA, 1276 bp, Papaver bracteatum
cacctctctcaataatttcgcaagtatttcattttgtttctctccctagtttagcctagattgtctcatcatgggttcaatagaagaagtgaggaaggaatcagcagaggaaactctagggagattgttaagaggagagattaatgatgaggaattgaagaaactcattaagtttcaactcgagaaacgtcttcaatggggttataaatcatctcatcaagaacaactctccttcaaccttgacttcattaaatccttgaagaagatggatatttcaggagagattcagacagtcaacaacgaaacctacgaattaccaactgaattcttagaagcagctttcggaaaaagtatcaaatcaagtgggtgttacttcaaacatgaatcagcaacaatagacgaagcagaagaagctgcacatgaattatactgtgaacgagcacaaatcaaagatggacaaactgttctcgacattggttgtggtcaaggtggtctagttctatacattgctcagaaatataagaaatgtcatgttacagggctcactaattcaaaggcacaagtcaattacttactcaagcaagcagagaagcttgggctgacaaacgtcgacgccatactagcagatgtcactcaatatgaatctgacaagacatacgatcgactacttatgatcgaagccatagagcacatgaaaaacttacaactgttcatgaagaaactatcaacttggatgacagaagaaagtcttctctttgtggaccatatctgccataaaacctttgctcacttttttgaggcagtcgacgaggatgactggtactcaggtttcatcttccctccaggttgtgcaaccatactagctgctaatagtctcctctatttccaggatgatgtttcagttgtggatcattgggttgtcaatggaatgcacatggctcgttcagtagacaattggagaaaggcactagacaaaaatatggaagctgcaaaagaaattctattacctggacttggaggaagccacgaagcagtgaatggagtcgttacacacattagaacattctgtatgggaggctatgaacaattctcaatgaacaatggagatgagtggatggttgcacagctgcttttcaagaagaagtagtgaggcaatttccaaggcaactgcattttccagagctgtgtaataatgtggtcctcaagtaacaatacttgtgggttgtatcacagggatttgacttgtttttgttgtctgagatcggaagagcgtcgt

SEQ ID NO: 503 - DNA, 1220 bp, Papaver bracteatum
catgtattcgaattcatttcccattaacaataacaagattattaaggcaacataaccatggcaattgaagatctttgagagcaattattaatctttaaatagaacacttaaagaggaaatgcaaaaacatttgttaggaatatctctccatttatagcaatcactttttcttgaatagaagttgtgaaatcatccattcttctccattgttgaatgagaattgcacagctcctccaacaaagaatgtccttaaatgagtaattacttggttcgcggcttcttcacttccaagtccctgctttagttccttttttgcaacatccaaatttttgtctaatttctttgcccattcctcttgcgaacgagccatatgcattccattcaacagccaatggtcaacaactgagacatcatcctgaaaatatagaagagccgtcaaggacaatattgtcacactccctttcggaagaacgtaactagtataccaatcatcctcatcgagtgcctcgaaatgatgattgaatgctgtgtggcaaaggtgttccacaaaaagaaagctaccttcatctttcatccactttgatattttcttcataaacagttgaatgttcttcatgtgctcaatggcttcgataactagaattcgatcaaatttcttctcagttacgaagtcgaatttagtaacatcagctaatataatgtccacattccatagcttaagcttctctatttgcgacaaaatgtaatttctttgtgcagtggaatttgcaattccagtaacatgacaattcttatatttttgagcaatatgaagaactaaacccccaaaaccgcaaccaatgtcaagtatagtttgcccgtcttcaatttttgctcgctcgctgttcaactcgtatgcagctatctctgcttcgtctagcgtcatagattcgtcttcaaaataacaagcactttgtttgagggtgtttccaagagcagcttcaagaaaagctgtaggcagttcatatgtctcactattcatagtctctaaatctccggacatctccatctcttttaaggattttatgaagtcgatattggaagtaagttggtcttgaagtgtgggtttataaccccattgcagaatcttttcaaatcgaattttaatgagcttctttaattcttcatctccaatatctccattcaccaatctctccagtatctttcccctttttttcaat

SEQ ID NO: 504 - DNA, 1410 bp, Papaver bracteatum
ttatatacgctaacatacgaagtaaaataccacaaaacactttccggactatcaatctaaaataaattaaactcttccttctgcatcctccataacagttttcgtcatgtcttcatcaaacgttcgatcctgggtacacttcaactaatacaccgtcgggcaagtagctagctaacaagtcagcagctaggtttacttccctggagttctcaattttttcttgaagagaagatgggtgagcatccattcttcaccattcttgtaaccaaacaactctgctccacacatgcaaaaaatcctccaaaaattgagcaatttgtttgcttcttcctcagttttcgttatagacttcattatctctttgaatttaacaatgtttttatccatgtttttcaaccattcttcatgggatcgagagtaatgctttccacttagagtccattgattcacaacagaaacatcatcttggaagtaaagaagcattgaagcagatgatagagtcagagttccagcagggaatacgtagttagtgtaccaatcttctgcatcaacaggctcatagtggtaagctagagttttatggcaaacatgttcaacgaaaagaagtccatcatctttcatccattctgatattttcttaagaagcaattgatagttcttcatatgctcaatcaattcaacagcaaaaatccgatcaaatctttcttcagtttcgtaagttgttatatcagctaataaaaccttgacgttggtcaacttaagttccttgcattttctttcaatgtaatctttttgttccatagaacttgtaactccggtaaactgacaatttttaaatttgtttgcaccaaagagagcaacagcacccaatccacaccctaaatcaagtacactctgaccatctttgatctgtgccctctccatatacaaatccagcatcgctatctcagcttcatccaacgtcgttgattcatcggtgtagtaaccggcactttgtttcatgttgcttccatgttgaatttttaagaattccataggtgcctcgtatagtttcaaatccaaattctccatctcagttgccattttcatacctctcaaagaatgaactaattcaagaagctgagaaagctgttcttcgtgtgtttctttgtaaccccattggagacgcttttctaattcgattctaatcctttgtctaatctcttggtccggaatcaacccaagctccatgtttctcaaaagctcttcttttgccattagctgcatcttgttcaacttgcaaagaaaaacacacacaaggtgaggtataatttgattttccggagttgttgagacaggtggtagtggttatggtactacgggtgcagaacagagtcaaagacacggtagtggtggtggtgttttaagtcc

SEQ ID NO: 505 - DNA, 1535 bp, Sanguinaria canadensis
gaccgaattctgaagtgagtggagtgggttttcctaattaatttcttctgcaatcaacaaaaacctctcaatttcgattgagattgggatttttttatctgagaaatcattcaattgtttcgattgtgtgtgtgtgtgtgtactgttcctggaatccatatatattttcgaattttggttgtttttgttcggtttttgaattcaatttctggtccattgtttgatctctctctctctctctctctctctctctctctctctctctaaacattaatggcttccgatcatgaagttagtaataaagaactaaagaagaagaaggaagtgattacggaattgttgaagcgtttggagtcgggattggtgtcagatgaggagctgagagggctaatcagattcgaattagaaaggcgtctcagatggggttataaacctactcatgaacagcagcttgctcaactcctcaacttggctcactctatgaagcaaatgaaaattgcaacggaaatagatgcgttgaattcgacaatgtatgaagtgccaattcccttcctacaaatacagcttgggagcaccctcaaagaaagctgctgttattttaaggatgaatcaacaacagtagatgaggctgagatagcaatgatggacttatacttagagagggcacaaataaaagatggccaaagcatccttgatctcggttgcggactcggcgcccttgcgtttcatattgcgcaaaagtacacaaactgcaatattacagcaattaccaattcagtcagacagaaagaattcatagaggaaaagtgcaaaattcttaatgtatcaaatgttaaggttagtttagcagacatatgcaccctagaaatggaggccaccttcgacaggattttcgctatcggactgattgagcatatgaagaattatgaactacttcttaagaagttttctgagtggatgaaacaagatggcctgatctttatagagcatctctgtcacaaaaccttggcctatcattatgagcctcttgatgaagatgattggtatactgagtatttcttcccggccggaaccttgactttgatatcatcctcctttcttctatactttcaggatgatgtttcagttgtggatcactggactctgagtggaaaacatttttctcgttccaatgaagaatggttgaagagaatggatgaaaagattgatgaagtgaaagaaatattcgagtcagtatctgatagtaaggatgatgacgttacgaaattgattaaccattggagattcttctgcataagctccgcagagatgttcggttacaacaatggcgaagaatggatgatttcccaagttctcttcaagaaaaaataaattctacagcttcttacatagcacgcttttcgttaagttaaaacgaaattattgattaatccttgatattaattaaccaagaaaatgcagctattttgattatttcatgccttcctaaatgtgtgtttttgtgctttttgaaagtgtattatttccccctagtg

SEQ ID NO: 506 - DNA, 1271 bp, Sanguinaria canadensis
tttaagctagtcttagatggttagagaacgcacatttattaaaaagacaaagtacatataacaagcaaatattttaggtgtttgagatcaatcaaaccagtagtattcattattcaaagttttcaacatgccatgtattactaaatttgtttcttcttcttgaagagaacatgagagttcatccattcttcaccgtcattgaagccgaacatctccgaggagttgatgcagagcattctccagtggtttatcaacttcacaacttcttcctcactatctgtaattgacttgactatttctcttattttgtccatcttaccatcaatgttcttcaaccattccttattggtacgagaaaaatgttttccactcatactccaatgatctacgagcgaaagatcgtcctggaagtatagaagaaatgaggctgatactaaagtcaaagtcccagcaggaaagagtagattagtataccaatcatcttcatccataggctcaaagtgataagacaaggttttgtgacaaacatgatcaataaagagaagaccatcttgtttcatccagtcggatagctttctatagtagctcataattctccatatgctcaattaaaccgatagcaaaaagacaatcaaaggtatcatccatttcaagagtggttatatcagctaaaagaaccttaacatttggtacattaagagtcttgctcttttcctcaatgaactctttctggcttactgagttagtgaccgcagtaatgttgcagctcgtgtactttcgagcaatgtgaaaacaaacggaacccagcccacaaccaagatcaaggatgctctgcccatcttttatctgtgccctctccaagtataaatccatcattgctatctcagcctcatccactgttgttgtttcatccttaaagtaaagacaactttctttgagatggctaccaagttggatttgcactaaggaaatcggaacctcatacattgtagaagtcaagccatccatctctgtcgacgcaattttcattttcttaattgagtgagccaaattgaggagttgatcgagctgttcttggtgtgtagatttataaccccatttgagacgtctctctaattcaactcgaatcagacttctgatctcatcatccggaactaatcctgcctccaaacgcttcaacagatctgcaatcatttccatctttgaaccacttacagcttgatcacttgtaaccacttgagattaatcaaccgaaaagtgtgtgttgatgg

SEQ ID NO: 507 - DNA, 1489 bp, Sanguinaria canadensis
tcaaatacacgctaagataaagagtcgattacgacaatgaaaagcaacaatttagacagacactcattgatttgatcaatccataactcaaatagctttaagaatttatttcatcattctagaaaagaaaatgtaagcaatgaaaatcaagataaaagcgtcgaaattacatcagttattaatacaagaaaatcccaataatacatagaactcatggaaatgcagttgttgatgtagaatttgcatttgatcacttcttcttgaacagcatctgtgctaccatccattcctctccattgttgaatgagaattgttcataacctccaatgcagaaggtccttatgtgagtgataacttggttcactgcttctttgctaccaagcccaggttctagtatctctcttgcagcttccatgtttttgtctagtttctttccccactcctctactgaacgagccatgtgcattccatttacaacccaatgatccacaactgaaacatcatcctggaaataaagaagagcagaagccgatggtagcgttacacaccccttcgggaagatgaaacccgagtaccagtcttcctcgtcgagtgtctcaaagtggtgactaaatgttttgtggcagatgtgatccacaaaaagaagactgtcctttttcaaccatgttgataatttcttcataaacagttgaatgttcttcatgtgctctatggtttcgataacgagtatacgatcataggtctgatcagaatcgaatttagtaacatctgctaatataacatcgacgttcgacaactgaagtttctctgcttgcatgacaatgtaattcatttgtgcctttgaattggtaatccctgtaacacgacagttcttatatttttgagcaatatgaagaacaagacccccttgaccacatccgacatcaagaacggtttgcccatctttgatttgtgctcgttcgcagtataactcgtgcgaagcttcctctgcttcgtctagtgttgtcgatttgtctttgaagtaacaagcactttgtttgatggtctttccaaaagctgcttctaagaaagctgttggtaattcgtaggtttcttcgttcattgtctcaatctctcccgacatatccatctttttcagggatctgatgaagtcgagattgaaagagagttgttggtgatgggtgggttggtaaccccattgaagacgcctctcccacatattcctaatgagtttcttcagctcatcatctccaatttcacccttcatcaaccttcccatgatctccccagctctcgctgataatccaccattaatcttcttcttcccttcttcattagaaccacccatattaattaatttacacagaagagatcgagagagacactgatcagaaaccagtctacaattctagagagagaaagtaaagatcagtagagagagagatggaggggaaagaggaggatgtgaagttgggagcgaacaagtact

SEQ ID NO: 508 - DNA, 1396 bp, Sanguinaria canadensis
acatctgacgaaataactgttaggaaccccttctataaattatatagaaatcagactcgtttcaatacaatacaaggtaacaagtttcttacttttatttcaactgtaggttcttaaatccacccaaaaaaagttgctaaaaatttgaacttaaaaattatagatttcttaggatttacttttaaattttaacttattcaagggcatggcttcaaaagaaaagatgaatcatttcttgtacagaacatgagaagccatccattcttcaccattgttatatccatacatttccattcctgataaacagaaacctctccaatagttaatccatttcactgcaccttctttgctgcctgaaaacggctccattatcttcatcacttcttcttcattggcatctaatctcttcagccattcttccttggtacgtgcaaaatgcttcccgctaagcgtccagtggttcgcaatcgaaaggtcatcctggaagtacaggaaaagggaagcagatggtatgatcatcgtccctgccgggaagatgtattcggtgtaccaatcgtcttcatcgataggctcgtagtgataagcgaaggctttgtgacatatgtgttctatgaaaagaaacccgtctttcgacatccattttgatatcttacgaagaagtagctcgtagttcttcatgtgctcgaacagttcgataaccaaaattcgatcgaaagtatcctccatttcatgtgtagttatgtctgctaacatgacctcaacattcttcagattaagcttcctggattgctcttcaatgaactctttctgtgatacagagttggtaactgctgtaactctgcaatttttgtacttgtttgcaacatgtaaagtaagagctccctggccacaccctagatcaagaacactctgcccatcttttatttgagccctctcgcagtacaaatctaacatggcgatctctgcttcgtctaatgtcgtcgaatcgcctttaaagtaacagcagcttcctttgatggtgcttccaaacatcaactgaaggaaggggatggggacctcatacatttgctcatccaatgtatcgatctctgtcgctatgttcatggttcgcagagagcgagccaatttgaggacttgagaaagttgttgttcatgggtaggtttgtaaccccattggagacgtctacccaattcaatcctcatgagacgtctgatttcatcgtatggaaggagcccaagttccaaatttctcaacaactctgcaacttctgccttctttgctagtggtggtgatgtctctgtaatttctacagtgctcattttagagagagaaactagagagagagagagagagagagagagagagagagagagagagagagagagagagagagag

SEQ ID NO: 509 - DNA, 1420 bp, Sanguinaria canadensis
gaagcttacatgaatagctgccttactctgcctccactgctaactctttctgtaatatatctttcaatctattgaaactatgggaggtgttgcagatttgttgaagaaaatggagcttgggcttgtacctgaagaagagatcagaagactaatgagaattataatcgaaaaacgtcttgaatggggttataaaccgactcatgcagaacaactagatcatctcaccaacttcattcagtgccttcgaggtatgaaaatggcagatgagattgatgctttagatgcaaagatgtatgagattccgcttccctttatgcagactatatgtggaagtacccttaaattcagtccagggtacttcaaagatgaatcaacgacattggatgagtctgaaattcatatgatggatctatactgcgagcgggcagaggtcaaagatggtcatagcatccttgaccttggttgcggacatggaggtttcgttctacatgttgcacagaagtataaaaacagcatcgttacaggagttaccaactctgttgcagaaaaggagttcataatgacacaatgcaagaagctttgtctatcaaatgttgaaatcatactagcagacgtaacaaaattcgaaccagagacaacctacgatcgtgtatttgctattgcactgattgagcacatgaaaaattatgaattagtcctagagaaattatcgaaatgggtggcacaagatggatttctttttgttgagcatcattgccacaaagtcttcccttacaaatatgagccacttgatgaggacgattggtacaccgagtatatcttccctggtggaaccatagttttaccatcagcctcaattctcttatactttcagaaagatgtttcggttgtaaaccactggagtctcaacggaaaacatcctgctcgtggcttcaaggagtggttgaagagattagatgaaaatatggatgctgtaaaggcaatatttgaaccattctatgggagcaaagaggaagctatgaagtggattacttattggagagtattttgcataacacattcagagatgtatgcatataacaatggtgaagaatggatgctttcacaagtcctcttcaagagaaagtaatttgtgtgtcactctctagcgaacattatctattagatttactgaataatgatgtgttcgagcttgttttaaagtatagtgattttccatcgaaatattgtaacttatagtgcatattaatgaactccaaggggattcatttcgggtgatggtacgcaaatatgaagtgatctccgagtagttcaagaactatgtatcgaatggcagctatggtttttgttttctaagtgtaattttgattgagcaagaagttttacttttatgtcacatattgtttctccagcattttat

SEQ ID NO: 510 - DNA, 1402 bp, Sanguinaria canadensis
cacaccctcacttaaactcgcacaaggtggtcgacgttcgaatgacaaattgatcacctgtttagggtgtatcaaccatcaaaaagtttgggggaccagacaaatcaatgagaaggaaagaagggttgaagtctgatagatcttgtaaatagcatataccttcgaccctaccgacatacgtcaaatattattagttaagaaatacagatctctatgttatttcttcttgaatagaagatgagtaaccatccattcttctccattgttataaccaaagagctctgccacagaaatgaaaaacgtcctccaataagcagtccatttcaaagctgaatctttgccgtatgttgactccattattggctttattgaatccaaattttggtccattcttttaagccattcttcacttgtcagtgcataatgtttgccatttacaagccaatggttgacaatagaaacatcttcctggaagtagagaagtagatttgcagaaggcattgtccctccagtgaagaagtatctagtaatccaatcatcttcattcgtgtcctcaaagtggtaagcaaaagctttgtggcagaagtgatgaataaaaaggaggctatcatgattcatccacttggatatcttcttaagaagctccttgtagttcttcatgtgctcaaacatttctatcgatacaattcgatcgtatgtggcctccattgcaaatgtactaatatctgctacaatgatctccacattctgcaactgcaggtccctgcattgttcttcaatatgtgctttctgagttgctgaattgcaaatccctgtaatcttgcagttactatatttttgtgcaatgtatagagaaagggatccccatccacacccaacatcaaggactgtatgaccatcttttatttgtgctctctcacagtaaagttccaacattgcttgctctgcttcttctaagctcttcgacttatcagagaagtaacagcagctgtatttcatatattttccgagaaccaacttgaagaaagaggttggtaattcataatgttggactttaggcttatcagtcttgatggctattggcatatcttcaagtgattgtgcgaattgaaggagatcagagagttggagttctgaagtaggtttgtagcccaaacgaagacgactagctaacaacaacttcgtgagtttccttatcaccacgtccggcagtaggtttttctccagtgaagttagcatcaagcgcacggtagcattgtacggtacctgaatcaacgcagccatggcgtttctctctctactttctctctctcttatcgttcaagatggaagacctctctatcagttatcccaactatggaccggcctcaacatccacctcagcatccaacgggctcaaaca

SEQ ID NO: 511 - DNA, 1383 bp, Sanguinaria canadensis
gtgatgtcgagatcttggatctgttggagaacatggatccaagaatctctggtgctgaggaagaaaccaacttgggagagatcaagatcggggctagggtttgagagagtgatgtgagagacgttgagttcgagacgaccggtgtgtgtgaatccgaattcatcgaaagggattatggatcgatcgtctgaatggatttcggagaaacggatttcagcaaaggagatggagaaaaaggcagagatgataagaaagttggagcttgggttgattcctgacgatgaaatcaagagattattaggcattcaaatggaaaatcgtcttcgatggggttacaagcctacgcatgaacaacaactggctcaactccttgacttcgctcattccctgcgaaaaatgaaaattgcggatgaaatagagtccttggagtcccaactatatgagatgcccgtctcctttatgaagatcatgaatggttcaaagcttaaaataagttccagctactttaaggatgattcaatgactttagatgaggctgaggtagcaatgttggacttatattgtgagagggcccaaattaaagatggccagactattttagatcttggttgtggcatgggtgcctttactttacatgtcgctgaaaagtataaaagttgtcgtgttacatccatcaccaattctgtctcacaaaaagagtacattgaggatcaatgcaggtccaataatttgttaaatgtggaagtcatacttgcagacataacgaaatatgagatgtatgacacctatgatcgcataatggccattggattacttgagcacatgaagaattacgaactccttctaagtaagatatcgaaatggatgtcacaagatggatttcttttcatagatcacatatgtcacaagacattagcttatcaatatgagcctcttaatgaagatgattggttcacggactatattttccctcctggtacttttatgataccatcagctactttccttctatattttcaggatgatgtttcagttgtaaaccattggactcttagtgggaagcatttcgagcgtacccacgaagaatggttgaagagaatagacgcaaatattgatacagtgaaagtaattttggaagaagctttaggcaataaagaagctgcaatgaagtttatcaactattttaggaatctttgcttatttggaataaccatgttcggatataacaatggtgaagaatggatgatgtctcatcttctcctcaagaagtaatgatttcttgctccgtagtctatgtttccgtaataaatatttctgatggaattattggagtcacaagtagtcaaacctatcattatgtggagttttattatatttaccatg

SEQ ID NO: 512 - DNA, 1276 bp, Stylophorum diphyllum
ctcttctgtcattctcttttaatttgagaatcagatatgggttctaatgaagcaccatcagttaatggatcgtcaaatgcagggaagatcatggagaggttgatgaagggggaaattggtgatgaggagcttagtaagctcgttaggcatatgtgggagaggcgtcttcaatggggttacaaacccactcatgaacaacaacttgctttcaacttcgatttcatcaaatccctcaagcatatggacatgtcaggagaaattgatacaatgaatgaagagacctacgaattaccaacggctttcttagaagcagccttcggaaagaccatcaaacaaagtggatgttacttcaaagacgaaacgactacattggacgaagcagaggaagcttctcatgagttatactgcgaacgagcacaaatcaaagacgggcaaagcgttctagatatcggttgcggtcaaggaggtcttgttcttcatattgctcagaaatataagaactgccatgttacagggcttactaattcaaaggcacaaatgaattacattttgatgcaagcagaaaagcttcagttgtcgaatgtcgatgttatatcagcagatgttactaaatttgatactgataagacttatgaccggatactagttatcgaagccatagagcacatgaagaacattcaactgtttatgaagaaattatcaacctggatgaaagaggacagtcttctatttgtggatcacatcagccacaaaacatttaatcaccactttgaggcactagacgaggaagactggtactcaggtttcattttcccgaaggggtgtgttacaattctatcctcttctactcttctctatttccaggatgatgtttcagttgtggatcattgggtcgtaaatggaatgcacatggctcgttcagtggaagaatggagaaagaagctagacaaaaatatggaagctgcaagagagatactagaacctgggcttggtagcaaagaagcagtgaaccaagtgatcacacacataaggacattctgcttaggagggtatgaacaattctcattcaacaatggagaggaatggatgattacacagatgctcttcaagaagaagtgatatgcaagttctccaactactacatttccaagaattctattatgtaataatgggattttcttgtattcataactgttgtactttcagcgctcttgatttttatttacactttcttttttatcaacaagaattgaataaattatgcttttcaacatcc

SEQ ID NO: 513 - DNA, 1275 bp, Stylophorum diphyllum
cgcttgatgatgaagtttttattaaaaaaacataaaataaaagttacaacccaatcattctaaacagttcttattacaatgaattggtatactatgatgctaaataacacacccaaaacgaaagcataaaagaaaatttctcattttttcttgaagagaagatgggtgagcatccattcttcaccattcttgtaaccaaacaactctgctccacacatgcaaaaaatcctccaaaaattgagcaatttgtttgcttcttcctcagttttcgttatagacttcattatctctttgaatttaacaatgtttttatccatgtttttcaaccattcttcatgggatcgagagtaatgctttccacttagagtccattgattcacaacagaaacatcttcttgaaagtaaagaagcattgaagcagatgatagagtcagagttccagcagggaatacgtagttagtgtaccaatcttctgcatcaacaggctcatagtggtaagctagagttttatggcaaacatgttcaacgaaaagaagtccatcatctttcatccattctgatattttcttaagaagcaattgatagttcttcatatgctcaatcaattcaacagcaaaaatccgatcaaatctttcttcagtttcgtaagttgttatatcagctaataaaaccttgacgttggtcaacttaagttccttgcattttctttcaatgtaatctttttgttccatagaacttgtaactccggtaaactgacaatttttaaatttgtttgccccatagagagcaacagcacccaatccacaccctaaatcaagtacactctgaccatctttgatctgtgccctctccatatacaaatccagcatcgctatctcagcttcatccaacgtcgttgattcatcggtgtagtaaccggcactttgtttcatgttgcttccatgttgaatttttaagaattccataggtgcctcgtatagtttcaaatccaaattctccatctcagttgccattttcatacctctcaaagaatgaactaattcaagaagctgagaaagctgttcttcgtgggtttctttgtaaccccatcggagacgcttttctaattcgattctaatcctttgtctaatctcttggtccggaatcaacccaagctccatgtttctcaaaagctcttcttttgccattagctgcatcttgttgtttaacttgcaaagaaaaacacacacaaggtgaggtataatttgattttccggagtagttgagacaggtggt

SEQ ID NO: 514 - DNA, 1395 bp, Stylophorum diphyllum
aattcatgtttcctcgaattcttgtttccaaggattcatgtttccttaatgaatccctaaaagatgaatccctcatccaaacaaactattaagttacaatttgcaaaccagaatatttgataacataggtgaacattttattacttttagttcctccaatccacacccccaaargaaaagttgctcaagttgaacttaaaaattgtagaattcttattcaaggacttcttaacaaagatgccattaaaagaaagaaatagaaaagcttaatcatttcttgaacaaaacatgagaagccatccactcttcaccattgttatatccatacatttccattccagataagcagaatcctctccaatagttagtccatttcactgcaccttctttgctgcctgaaaatgactccattatcttcattacttcatctacattggcatctaacctctttagccattgttccttggtacgggcaaaatgctttccactaagtgtccattggttcacaaccgataggtcgtcctggaagtacaggaaaaaggaggcagatggtatgatcattgtcccagctgggaagatatactcggtgtaccaatcgtcttcatcgagaggctcgtagtgataagcaaaggttttgtggcagatgtgctctatgaaaagaagcccatcgttcgacatccatttcgatattttacgaagaagtagctcgtagttcttcatgtgctcgaacaactcgataaccaatattcgatcgaatgtatcctccatttcatgtgtggttatgtctgctaacataacctcaacattcttcagattaagcttcctggatttctcctcaatgaattctttctgcgaaaccgagtttgtaactgctgtgactctacaatttttgtacttgttagcaacatgtagagtaagagctccctggccacacccaagatcaagaacactctgcccatcttgtatttgcgccctatcgcagtacaagtctagcattgcgatttcagcctcgtctagtgtcgtagactcgtctttaaagtaacagcagcttcctttgatggtgcttccaaacataagctgtaggaagggaatgggaacttcatacatctgctcatccaacgtatcgatctccgtcgctatgttcatgctacgtagagatcgagctaatttgatgacttgagcaagttgttcctcatgtgtaggtttgtaaccccattggagacgcctacccaattcaatcctcattaaacgtctgatctcatcatatggaaggagcccaagttccaatttcctcaacagctctgcaacttctgccttctttgcatttgatgattctgtaatttccacacccattattctagagagagaaagagtattgtagagagagagagagga

SEQ ID NO: 515 - DNA, 1467 bp, Tinospora cordifolia
caccattttcaccgagtccgatcttcttactcattttccttcttcttcttctcgttttttgctggttgagccgtggtttggtcatatcagtagtactgcgttgtaatggcggtgactaagagggaaaaagttgaagcgatattgaagaagttggagctagggttgattccagatggagagataaggaagatgataagggtggagctcgagaggcgccttgaatggggttacaaacccacccatgaacagcaaacagctgaagttgtcaactttgctcagtctcttcgcaaattaagcattgcaatggaaatggatacattagacacggagatgtacgaggtgccaatctcatttttgaaaattatgtttggaaacacaatcaaaggaagctgttgttacttcaaagatgaaaacacaacgttagatgaagcagaggtagcaatgttggatttatattgcgagaggtcacaaataaaagatggtcaacgagtgttggaccttgggtgtggtcaaggtgctctcaccatgcatgttgccagaaagtacaagaattgctatgttactgggattaccaactcagtatctcagaaagagtatattgaagagcaatgcaggatcaacaacttgcccaacgtggaggtcatattagcagatataaccacacacgaaacggaagacaaatttgaccgaatattagttattgaattaattgagcacatgaagaactatgagctacttcttcgaaagttttcgcaatggttgacaccagacggattccttttcattgaacacatatgccacaaaaccttggcttaccaatatgatcctgttgatgaagatgactggttcactgaatatgtctttccttctgggaccatgattgttccatcagccaattttctattatatttccaggacgatgtaacagttgtgaaccattggactctcagcggcatgaattattcgcgtacccatgaagcatggctgaagaacatagatgctaatgcagaagcagtaaaggaaataatggtgtccttcactgggagcgaggaggctgcagtgaaacaaatgaactactggagaggattcaacttatctgggatggagctctacaagtacaaaaatggtgaagaatggatggcctgtcatattcttttcaagaagtaatgaaaccaaacatacatttatatagatactctgcaattcattgtttttgctgcatttcatatctctaatgtattccaaaaccgtaagagtattgaattgaataagaactaagagacccaagttacattcttgcatgagaaagctaacagagtttaagaacaatgatatgcatcagatgatatactcatacatgatcaggaaaacccaaatatgtactgggctcctaccttctttttatcatagatctgtaacgcaattgaatgatgatattcagaaacacaaaataatcataatgataaa

SEQ ID NO: 516 - DNA, 1378 bp, Tinospora cordifolia
atatggcataaagcgtggatttcacattcatttaattttataaccttatggatgcattccaaaatgtatatgacttcacactgaattttgctgcatcatttcttcttgaagagaagatgagataccatccattcttcaccattgttgtacttgaagagttcaatcccaaataggtttaatgctctccaatagttcacttgcttcattgcagcttcatcgctaccagtgaaccttgtcattatctctttcattgttcctacattagcatctatcttcttcaaccattcctcatgggtacgggagggatgctttccattgacaatccaatggcttacaactgaaacatcatcctgaaaatatagcaacaaatttgctgatggaaaagttaaagttccaacgctaaagatgtactctgtgagccaatcatcttcgtcaagaggctcgtagtggtagggtataaccttgtggcaatagtgttctataaaaagaagtccatttggcgtcatccactgtgatatcttacgaataaatagctcgtagttcttcatatgctcaattaaaccaatagccattattcgatcaaattttttatctgtctcatgcgtcgttacatcagctaatatgatcttcacattggatatgttattgttcctacactgctcctcgatgaactctttttgagatactgagttggtgactcctgttacttcgcaattgctatacttttgagcaacgtaaaagaccaatgcacctgctccacatcctaaatctagcactttttcaccatcttgtatttgtgccctttcgcaatataaatctaacattgctatctcagcctcgtccagcgtcataaaatcatctttgaagtagcaacagctttgtttgatcatgctccctgacgtaaacttataaaaggagattggcacctcatacatctttgagtccaatgcatcaatctctattgccatgctcatcttacgaagagaatgggcaaagtcgacgagttgggcagtttgctcttggtaggtgggtttgtaaccccattggagacgcttccccaactccatctttatcacccgtctgatctcttcatctgggatcagtcccatatccatcttcttcctcagatctgccgcaatttctcccttgttagcccctggcgccattaaaacaccctgcaactcaacaactcaaccaacaacaacaatagaagaatgctgaacatgtatgacttgattatacggcagagctccttctatttatagatagatcgatagcggcaatagagctcatcttaaggcatgaacatcatgagtgaacagacgacagccctagatcttttatctttaattattacaactagcttgcgtgacctctc

SEQ ID NO: 517 - DNA, 1384 bp, Tinospora cordifolia
taattttattttaaaattggaaacttacataacatttcctacatgcaaagccacttaatattccatatatagcccagttgattcagtggttacaacataaatttatataaaaaaaggttctatttattttaaaatatctatattctttaaacacttctctcattattcctgcataataaacttcttcttgaagaggaaatgggcacccatccattcttcaccatcattgtatgaaaacatctccacaccagtgatgagaaacaccctccaataattgatgaatcttactgcatcttccttgcttccatagctttcaatgaatatctcttttattttgtcaatgttaccatctattctcttcaacaattcctcaaaggttcttgctgaatgctgtccaccttgggtccactgtcttacaacagaaacatcattctgaaagtataaaataaatgaagccgatggtatgatcaagccccctgatggaaaaacatactcattgtaccatttgtcacctttgtcaagtggcttattttgatatgggaaggttttgtggcataaatactcaacgaaaagaaggccatcttgcttcatccatttggaaagttttccaagaaatagtttatagtcattcacatgctcaaatattccaagagcaaagatacgatcatatgaagccgcttctatttctattgttgctacatcagctaatatgatttcgacatttgttaagttgagttttttgcacttttccatgatgtactgtttctgagagatggagctggtaacccccgtgaccttgcagctcttgtatttttgtgcgacgtgtaaggtaagagccccatacccacatccaaggtcaagaacgcttagaccttccgttatccttgccctctcacaatataattccaacatgtttatcactgcctcttccaacgttgcggtgtcctctttgtagtatgtatcgctttctttgatgcaatccccatagagaagctgaaggaaggaggttggtgtctcatacaaccatgattttgggttctcatcctcgctttccatgttcaaggatggaagagagtggatgaattgaaaaaggtgagagagctgggcttcatgggtaggtttgtatccccatttgagacgcttttgaagctgtaatctggtgagcttcctaatcttttcatctggaaccaaccctagttctggcctctgcaagttccacaacgttcatctcttcctgaagcagattgttgttatcctccattaatggcttctaactcttttccgccactccaactgaacaacagaggctaactacttgtcataagcaaacattcaagagaaaaaaaaaaaaagggggggggctgggattgatgataatgaagat

SEQ ID NO: 518 - DNA, 1215 bp, Thalictrum flavum
ctttactaattcttattaattgcaccacaattattactacttaatttgacatgatcgtcaaaacgaatgcaatacgtaagatcaaatgcatgcacaaagacttgcatggatcactacttcttcttgaaaagcacatgagagatcatccattcctctccattgttgtatgaaaattgttcatatcctcccatgcagaatgtccttatgtgtgtaataactccatttactgcttctttgctaccaagaccaggtaatagtatctctcttgcaagttccatatttttgtctagcttttttctccatgcatctactgaacgagccatgtgcattccgtttacgacccaatgatccagaattgtaacatcatcctggaaatagaggagggcagaagccgatagaattgtcacacatcccttggggaatatgaaacctgagtaccaatcatcctcatcgattgcctcaaaatgatgactaaacgttttgtgacagatatgatccacaaaaagtagactgtcttctgtcatccatgttgatagtttcttcataaacagttgaatgttcttcatgtgctctatagtttcgatgacgagtatccggtcataagtcttatcactttcatgtttagtaacatctgctaatatgacatcaacgttcgataattgaagtttctcagcttgcatcaaaatgtaattcttttgtgcttttgaattggtaagccctgtaacatgacagttcttatatttctgagcaatatgaagaacaagacctccttgaccacatccgatatctagaacagtttgcccgtctttgatttgtgctcgttcacagtataactcgtgtgaagcttcctccgcttcgtcaattgtcgtcgtttcatcttgaagtaacatccactttgtttgatggtctttccaaaggctgcttctaagaaagcacttggtaattcataagtctcttcattcatagtatcaatttctcctgacatatccatctcctttagagatttgatgaagtcaaggttgaaagcaagttgttgttgatgagtaggtttgtaaccccattgaagacgcttcccaaagatttctttaatacgtttgcttagctcttcatctccaatttcaccttgcatcaacttccccatgatctctccaattgattccttcttcacttgtgcttcatttgaacccatttccaccaccaccaaaggtacactac

SEQ ID NO: 519 - DNA, 1404 bp, Thalictrum flavum
ggcacgagctcttcttcttctctaaagcaaattagcaataacatttttttttttttttttggattgaaaaatgattgtgggaggtaagcaagagttgtttaagaagttagagttgggtttgataccaaatgatgaagtcaaaaagcttatgaggattcaattggcaagacgtcttcaatggggttataaatctacttatgaagaacaaattgctcaagttcttgatctaactcactctttgcgacacatgaacattgcaatggaggttgataccttggattctaacatgtatgaggttccactcgactttttaaagattatgaatggaagcgccttaaaaatgagttcttgctactttaaagatgattcaacaacattagacgaagctgagatagcaatgatggatttacactgtgagagggctcaaattaaagatggacacagtgttcttgaccttggatgtgggcatggatcacttaccttttatgttgctcaaaagtataaaaagagtcatgttacagcagtgactaattcagtttcacaaaaagagtacattgaagaagaagccaggagacgcaatttgtcgaatgtggaagtgttactggcagacatagccacacatgagatggcagatacttatgaccgtatattggtagtcggactgtttgagcacatgaagaactatggacttctgttgaaaaaaatctcagagtggatggcaaaagatgggcttctcttcgttcaacacgtatgccataaaacctttgctttccactgtgagcctatcgatgaagatgactggttgtcagaatatgcatttcctgctgggactatgatcataccgtcagcctcattctttttgtacttccaggatgatgcatctgttgtaaaccattggactcttagtgggaagcatttttcccgtaccactgaagaatggttgaagagattggacgcaaatgtcaaagttataataccaatgtttgcaaccataactgggagtgaggaagaagctgtgaagttattaaactactggagaggattatgtttctttggagtggagttgtatggttataataatggtgaagaatggatggaaagtcatgtcttgttcaagaaaaaatgaaattttcatcaactttgcaatttggttttgtaacttaagttaaagctacaatttgattttggctcggcgtttgggagggtacgtagaaaggttctgcgatcttctgaaccactaggaataaatcatctctggaatagtattaatatgtaatccgggtttctttgttgttctgtcttaataagtcaacactcactgtttctggtgttgttctcttgatgtacctatttttcttatcaataaattttatttatcaaaaaactaaaaaaaaaaaaaaaaaa

SEQ ID NO: 520 - DNA, 1318 bp, Xanthoriza simplicissima
cgagttgaagatcgaaatagctatatcatagatcactaatagctatatcatatattttatttcatcgttccccaaaataaatcatacaaatgtagcagaggacaattgatctacaagctgcgctgctagtcctttctgggtgaagcagatatatgaatactcttccaaacttattcaagtgttgttactaatgaaagaaatataatactggacaagatagatcatcattttttcttgaagagaacatgacttgccatccattcttcaccattgttatatccaaacatttccattccagataaacagaatcctctccaatagttaatcagcttcactgcctcttcctcatttcccattaacgtctcaaacattggtttaataacatcaaggtttgcgtccaatctcttcaaccattcctcattggtacgcgaaaaatgcttcccactaagagtccaatggttcacaactgaaacgtcatcctggaaatacaaaaagaacgacgcagaaggtatgatcatagtcccagcaggaaacacatactccgtaaaccaatcatcatcgtccagaggctcatagtggtaagcaaaggtcttgtggcatatgtgctctagaaagagaagcccgtcttttgctatccactctgagatttttctcaggagaagttcatagttcttcatgtgctcgaacaactctattaccaaaatacgatcgtatgtctcagccatctcatgtgttgttatgtctcccagtgtgacttccacattcaacaaattacgtctcctggattcttcttcaatgtactctttttgtgaaactgaatttgttactgctgtgacgcgacaatttttatatttctgagcaacatgtaatgtaagagctccttgcccacatccaagatcaagaacactctgtccatcttgaatttgagccctttcgcaatataaatccaacatygctatctcagcttcgtctaatgtcgttgaatcttctttaaagtagcaacaacttccttttaagttacttccattcataatcttaagaaactcgataggaatctcgtacaattgagaatccaaggtatcaacctctgttgcaattttcatttgtcgcagagaatgagttaagttttggatttcagctatttgttcttcataagtaggtttataaccccattgaagtcgccttgccaattcactccttatgagctgcttaatatcatcatatggaaccaagcccagttccaacttttttaacaactctacaatagcttactttacttttagttagactttagacttccactgccatttgaaacttg

SEQ ID NO: 521 - DNA, 1008 bp, Argemone mexicana
atggaaggagagaaaggaatagtatgtgttacaggaggagcaggatacttggcatcatggctcatcaagaggctccttcaacatggctacactgttagaacaaccgttcgatctgatccacaattcaaagaagatatcagccacttgaaatccctcccagaagcatcaaagaatctccaagtttacgaagcagacctcgacaaaccaaaaagttttgacgatgttatcaacggttgcataggtgtctttcatgttgctcaccccattgattttgaagggaacaaaatgtctcaagataaagccattaaaatctctatagaaggaacactaggaattttaaaggcatgtttaaaatctaaaacagaaagtaggactgcagtaaagagagttgtttatacttcttctgtagctgcagctgtttttatcagcaacaaaaaagatgttgaagagattaatgagaatatttggacagaagttgaaaccctaaaaaagaatgaatttactagaaatgggtatctaatttcaaagacattaactgaaagatcagcattaaagtttgcagaagaacatgatttggatcttgttactttacttccttccatgattgttggacccttcctcacttctaatctccctttcagtttaacaatctctcaagctttggttctagataacaaagagaattgcaaaatattgaaaaacctgaataatgcagtacatatagatgatgtagcttcggcacaaatataccttttcgaatgcccagaagcaaaagggagacatatttgttcatcagttgatattactatccatgacattgcgaaacttatgtcaattaaatatccggaacttcaattaccaactgatttattaatggaaattgaagaagaaaagcctgtacatatctcttcaaagaaactcttgaacttggggttcaaattcaagtatggttttgaagacatgtatagtgatgcaatacaatgttgtaaagacaagggtttcctttaa

SEQ ID NO: 522 - DNA, 963 bp, Argemone mexicana
atggctgagtactgtgtgacaggagggaccggattcatagcttcttacatagtgaaagcattacttgagaaaggtcacaaggttagggcaacagtgagagacccagataatgtggaaaaggttggatatctttgggagatgcctggagctaaggaaagattaaagctagtaaaagctgatcttatggtcgatgggagcttcgatgatgctgtaaatggtgttgatggtgttttccatacagcatcccctgttcttgtgccttacgacaatgacgttcaggcgacgttgatcgatccaactataaagggcacgcggaatgttttgaaatcatgctctaaagcaagttccgttaagcgagttgtgtatacctcttcttgctctgcagtgagatatcgctacgatgttcaacaagtttcccctctaaatgaatcccattggagtgatcctcagtactgcaaaaaccacaatctatggtatgcgtacgcaaagacattagcagaggaagaagcttggaaaatagccaaggagagcgggattgatctagtggtggtgaacccgtctttcgtagtgggtcccttgattgcaccacaaccaaccagcacacttcttttgatactgggtatcgttaaaggactccgaggagaatatccaaatctcacggtgggatttgtacacatagatgacgtggttgctgcccatatcttagccatggaggagaccaaagcagcaggcaggcttatatgttcgagttccgttgctcacttctcagagatcatcggaatgctcaagtccaagtacccatcatatccatacgaaaacaagtgtggtgaccagaaaggagataataatccgcatagcatgagcagcaacaagattcagcagttgggtctccctcctttaaaaaatctaaatgaaatgtttgaagattgcatcaaaagctttcagaatcagggatttctgtga

SEQ ID NO: 523 - DNA, 987 bp, Berberis thunbergii
atggaaaatggaggagagaaagggagtgtttgtgtaactggtggagctggatacttggcttcatggctcatcatgagactccttgaaaatggttactctgttagagctactgcaagattagacccaaaattcaacgaggatgttactcacctcaaggcctttcctcatgcatcagaaaagctccaaatctttgatgcagatctcaacaaaccggatagtttcaacgatgtcattgaagggtgtgttggggtgttccatgttgctcaccctattgatcttgaagggaagagaccagaggcatcggtaaccaagactgcagttgatggagctctaggaattctcaaggcatgcttgcaagcaaaaactgtcaagaaggtagtttactcttctagtatggccgccgcggtgattagcaagttgaatgtccaggaaattgatgagagccagtggacagacgtcgacttctgtaggacccttgatgttcctggtatttcatatgttatctcaaagacagtgactgaaagagaatccatcaagttcgccaaagagcatggactacaacttgtgacaatgcttcctgcattgattgttggacctttcagctctcctagaattcctgaaagcgttgctatcgccctgtctttgtttaacggtgatccagagaaaccattaccagcatggaacactaatctggtgcacgtagatgatgtggttgcagctcaaattttccttttcgaatctccaaaggcagaggggagatacgtttgttgttcaactaatacaacagttccagagttggccaagtttattacaggcaaatatccagaactaaaagtccgacccgaattactcagcgatgtcggttcagaaaatattgtccgtctctcgtcgaacaagctcttaggcttgggatttgagttcaagcatggtctagagggaatatttgatggggcaatccaatgttgcaaagagaaaaatttactttga

SEQ ID NO: 524 - DNA, 981 bp, Berberis thunbergii
atggatgtcaaaggcaaagtatgtgtgactggggcatcaggatacatggcttcttggcttattaaacgactcctcttgtctgggtatcatgtctgcggaacagttagagagccagggaattctaagaaagtagctcatctatggcaattggaaggagctaaggaacggctccaattgctcaaagctgatctaatggaggatggtagcttcgatgatgctgtaatgggatgtcatggtgtcttccacaccgccacccctgtcttgacacccaacatggtcaaatctgatcctaaggctaaaatcttggcccctgctattaagggtaccttaaatgtgttgaggtcgtgcaaaaagaatccgtatcttaagcgagtggtcttgacatcatcatcaacagccattagggtgagagatgaggttgaccccaacatacccctggatgaaatgtcttggagctctgtggaacgctgccaaaggctccagatttggtatgcattatcaaaagttctagctgagaaggcagcatgggaatttgcagaagaggaggggatagacttagttactgttttaccctcattcataatcgggccaagtttgccacttgatttgtccctcactgcttctgacatccttggtcttcttaatggtgtatctgagaggttcacgcagcttggaagaatgggttatgttcacattgacgatgtagcactttgccacatccttgtgtatgaagaatccagtgcacaaggaagatatctctgcagttcggttgtgctggataacaatgacttggcgtcctttctagctctccgctatccaagcttacccataccaaagaggtttgagcaacttgatagaccatcttttgatttcaatacatccaagctgaagagcctgggcttcaacttcaaagggattgaagaaatgtttgacgattgtgtagcatcactcaaagagcaaggccatatttctcagacatga

SEQ ID NO: 525 - DNA, 963 bp, Berberis thunbergii
atgcctgagttttgtgtaactggaggaactggatttatagcagcttacttggtgaaagcattactagagaaaggctacaatgtcagggcgactgttcgcgacccagaggacgtagaaaaagttaagttcctatgggaaatgaatggagcaaaggaaagactaaagctggtaaaagctgatctcatggtggatgggagctttgatgatgccatacaaggtgtagacggtgtcttccatgctgcatcccccgttcttgtgccccaggatgatcacatccaggaaactttgatcgatccaattataaagggaacaataaatgttctgagctcctgctccaaatcacgcactgttaagcgggttgtactcacttcgtcctgttcttcaataagataccattatgatgtccaaaatgtctcccctcttaatgaaacgcattggagcgatcctgaatactgcaaacattacaatctgtggtatgcatacgcaaagacattgggtgagaaagaggcttggcgactggcagaagagaagggaatcaatctagtagtgatcaatccatcgtttgtggtgggccccttaattgcaccacaaccaaccagcacactcctcatgatactaaggatcataaaaggaaaactaggggagtacccaaacacagcattgggtttcgtacacattgatgatgtggtttccgcccacatgttagcaatggaagaaagtgaagcatcaggcaggtttatatgttcaagcaaagtagctcactggtccgacatcattaagatgctaaaggccaagtatccctcctacccaattgaaaccaagtgtgcgaagaagaaaggagatgacaagctacatagcatggacactagcaagattgaacagttgggactccgtgctttcaaaacactccctcaaatgtttgatgactgcatcaagagcttccaagacaaggaattgctgtga

SEQ ID NO: 526 - DNA, 1002 bp, Berberis thunbergii
atggaaggaggaggagagaaagagaaagggactgtgtgtgtaactggtggtgcagggttcctggcatcatggatcatcatgaggctccttcaacacggttacaccgtgaggaccaccttccggtctgacccagagttcaaagaagatgtcagtcaccttaatgcccttccaggagcatcagagaagctcgaaatctttgaagccgatctcggaaaaccggggagttttaccgaagcaattaatggatgtataggggtttttcatgttgctcatcctaatgattttacagggaaaactacccaagaccaaatggtcaaattatcagttgaaggaactcttggaattctaaaagcatgtttagattcaaagacggtgaaacgagttgtctacacatcctcaatagctgcagcagggttgatgaatgatgccaaagatgtcaaggaaatgaccgaacaaatatggacagaagttgatgcttttagaacccttaatattccagggatttcatatgccgtttcaaagactctaactgaaagagcagctatagaatttgcagaggaaaatgggttggatcttgttaccttacttccatcgatggtcgtaggaccttttatgggttccaatctcccaacgagtgtatccctgggtctatcattagtttttggggatgaagagcttttgaaagctataaaaccatcatgttcttcagtgcacgttgacgatgtagcttccgcagaaatatttctttttgaatgcccggaagcgaaaggaagatacatatgttctgcagctgaaaatacaattcatgacttggtcaaatttcttactgtcaaatatccagaacttcaattgcatactcacttattgaaggagattggagaagcaaaacctggacatgtatcatcgaagaagctaatgagtatgggattcaagttcaagtatgggtttgaggagacgtatgatgaagccataaaatgctgcaaagcaaagggtctcatttag

SEQ ID NO: 527 - DNA, 996 bp, Corydalis chelanthifolia
atgggagtacaaagagaaagagggattgtgtgtgtaactggtggtgcaggtttcttggcatcatggatcatcaagaggctccttgaacgtggttactccgtgaggacaaccatccaatctaatcctgatttcaaggaagacgtcagccacattacttcccttccaggggcatcaaagaagctccaaatatacgaagccgatctcggaaaacctgatagcttttcagaagccattaatggatgcatcggggtctttcatgttgcccatcctactgatttcacaggaaaaactagccaagaagaaatgatcagaatatctgtagaaggaactctaggaattttaaggtcatgtttagattccaaaacagtgaagagagttatctacacatcttccacagttgcagctgggttagggacgagtattgaagatactaaggtaataaatgaacaaatgtggacgaacgttgatgcttttaaaagtacccttaatgctcctggaatttcatacgcggtttcaaagactataacggaaagagcagctatagattttgcacatgaacgtggattggatcttgttacgttacttccttcgatggtcatcggaccttttcttggttcctatcttccgatgagtgtatctttcgctctatctttaatattcggtaatgaagaactcttgaagcatatgaaaccaacatcggtagtagatatagacgatgtagcttccgcgcaaatatttctatttgaatcctcggaagcgaaagggagatacatttgttctgcgggtgaaaaaacaattcatgaggtagctagatttcttcagaagaaatatccagagcttcaaatgcaaactgaaatattgaaggagattgaagaagaagaacctgttcacacatcatcaaagaagctaacgagcttgggattcaatttcaagtatgggtttgaggagatgtatgataacacaataaaatgttgtaaacaaaagggattactttga

SEQ ID NO: 528 - DNA, 999 bp, Corydalis chelanthifolia
atgggagtccaattagagggagggattgtgtgtgtgactggtggtgcagggtttttggcatcatggattatcaagaggctccttgaacaaggttattccgtgaggacaaccatccaatctgaccctgaatttaaggaagatgttagtcacattacttcccttccaggagcattagagaaactcaaaatctttgaagctgatcttggaaagccagatagtttttccgaggccattgatggatgtatcggagtctttcatgttgctcatcctattgatttatcaggaaaaactagccaagaacaaatgatcaaactatctgtcgaaggaactctaggaattcttaagtcatgtttagattccaaaacagtgaaaagagttatatacacatcttccacacttgcggctggattagggacaagtttcgaagatactaaggaaatcaatgaacaaatgtggtcaaacattgatgctttaataaatagcactgataatgctccaggaacttcatatgcgatttcaaagacactaactgaaagagccgctatagattttgcggaggaacatggcttggatcttgttacgatacttccttctatgattgttggaccctttatttgtcccaatctaccgaacagtatagcttacgctctatcttttgttttcggtaacgaagaactcttgaaatatttgacaccaacatcggtagtacatgtagatgatgtagcttctgcacagatatttctactcgaatgttcggaagcgaaagggagatacatttgttctgtgggtgaaaagacaattcatgaggtgactaaatttgttcaaaccaaatatccagagcttaaagtgcaaactcaagtattgaaggagattgaagatgaacaacctgttcacacatcatcaaagaagctaataagcatgggattcaagttcaagtatgggctcgaggaattgtacgatgaaaccattcaatgttgcaaagaaaagggttttctttag

SEQ ID NO: 529 - DNA, 996 bp, Corydalis chelanthifolia
atgggaggtcaaagagagagagaaattatttgcgtgactggtggtgcaggatttttggcatcatggattattaagaggcttcttgaacatggttactccgtgaggacaacagttcaatctaaccctgaatttaaggaggatgttagccacattacttctctcccaagagcatcaaagaaactcaaaatctacgaagctgatctcgaaaagccagatagctttttcgatgctattaatggatgtactggggtctttcatgttgctcatcctactgacttcacaggaaaaactagccaagaacaaatgatcaaaatatctgtggatggaactttaggaattctaaagtcatgtttagattccaaaacagtgaagagagttatatatacatcctccacagttgcagctggtttggggttgagtatcaatgatactgaggcaatcaatgaacaaatgtggacagacgttgatacttttaaaaatacccttaatgctcctggaatatcttacgcagtctcaaagactataactgaaagagctgctatagattttgcacgggaacatgggttagatcttattacgttacttccttcaatggtcattggaccctttcttggttccaatctcccgatgagtgtatctttcgctctatctttaatattcggtaatgaagaactcttgaaacatatgaagcctacatcggtagtggacatagacgatgtagcttctgcacaaatatttctattcgaatgttcagaagcgaaagggagatacatttgttctaacggtgaaaaaacaattcatgaagtggctcgatttctccagaagaaatatccaaagcttaaaattcaaacagaaatattgaaggagattgaagaagaagaacctgttcatacatcatcgaagaagctactcagtttgggattcaaattcaagtatgagtttgaagaaatgtatgacgaaaccataaaatgttgcgaagaaaatggattcctctag

SEQ ID NO: 530 - DNA, 1035 bp, Corydalis chelanthifolia
atgggtgccactgttattgatcaagagaacacagatgatcaagagatggtgatgagaaagggtcctgtggttgtcactggtgctgccggttatataggttcatggcttgtcatgaggcttctccaacatggctacactgttcgtgcaaccgttcgagatcccactaatgttggaaagacgaagcatttagtggagctacctggtgcaaaagaacgactcacgatatggaaagcggacatggacgacgaaggaagctttgatgatgtggtccggggatgcacctgttttttccatctagccacaccaatggacttcgaatcaaatgatcctgagaatgaagtgatcaaacctgcaatcaatggagttttgaatgtgatgagatcatgtaagaaatccacaactctgaaacgtgttgtgttcacaacttctgctggaactgtcaacgttgaagaggttcaaaagccatcatacgatgaaaccaattggagtgacattgatttctgtaggagaacccaaatgactggttggatgtatttcgtatcgaaaacattggctgagaaagcagcatgggattttgctaaagagaacaacatggatttgattacgatcataccaccattagtcgttggtcctttcattatgaatagcatgccacccagcatgatcaccgcgctcgccctgatcaccggaaatgaagctcattattcaatactgaaacagattcagttaattcatttagatgatctgtgcaatgctcatatattcttgtatgagcatcctaaagctgaagggagatatatttgctcttctgcagaccccacaatttatgaacttgccaaaatgttgaaggagaaataccctgagtacaacatccctacaaagtttgagggaatcgatgagtcgatcaagcgtgtccatttctcttcaaagaagcttacagacttgggatttcaattcaagtataccatggaggatatgtttgatggagccattcagacatgcagggagaagaatttactcccacttcaaagctga

SEQ ID NO: 531 - DNA, 1017 bp, Corydalis chelanthifolia
atgtcaattacccggaaaaaaacggtatgtgttaccggaggtactggctacattgctggggttctcattaagaagttgttagagaagggatatgctgtcaatactactgtcaggaacccagacgatgagaaaaagatttctcctctcttgaagctacaaggtaagtataatgaccttaagattttcaaagcagacctaactattgaagggagtttcgatgaggccattgcctgctgccattttgtcttccatgttgctactcctatacacgtccattcggaagaccccgagaatgacatgatcaagccagcagtccaagggacactcaatgtcttaaactccgtcacgaaagcagagacggtaaagagggtggttttgacatcatcggcgacaacattatcgataaacaaactgaatggggtgggttatgtgatagatgagaaaagctggacggatgttgagttcctgacttctgagaaacctcctaattggggatatgcggccatgaaaacacttgtagagaaggcagcatggaaatttgcagaggaaaacaagatagacctaatcaccatcatccttccactagtgacaggccaatcgttgactcctgaacatgaacctcccagcatgccctttgcaatggcactgctcacagggaacaatgacctgatcaatgtcatgaaagatctgcaaatgctattaggatctgtcgcaatgatacacttggaggacgctgttgaatgtcacatatttctagctgagaatgaatcggcttatggacgttacaattgttgtcccatcaacactggccttgtcgagctaggaaagttttttgaaaatcgatacccgcaatacaatgtccatactgattttggagattttcctgcacaggccaagctgagtatttcatcagagaagcttatcaatgcagggttcaaattccagcatatagggctcgaggaaatttacgatgaatcagtggagtattacattgctttaggattattgcaaaaatga

SEQ ID NO: 532 - DNA, 990 bp, Chelidonium majus
atggaaggagagaaagggacggtttgcgtaacgggtggagctggattccttgcatcatggctcatcatgaggcttcttcaatatggatactctgttcgtaccactattcgatctgatccaaaattcaaggaagatatcagccatctcaaagcccgtccaaaggcacaagagaagctgcaaatctttgaagctgatcttgaaaaaccagaaagctttgacgaggcaattgatgggtgcgtcggggtctttcatgttgcacaccctattgattttgaagggaagatatcccaagacaaaatgatcaaaacttcagtagagggaactataggcattctaaagtcatgcttgaaatataaaacagtgaaaagggttgtctatacatcttctatgggtgcagccatgtttgttagcaacattttagatgtaaaggaggttgatgagaatatgtggacagaagttgataacttcaaaaacattccgcttcctggcgtgccctatgcaatgtcaaagaccataactgaaagagcagctatagaattcgcagaagaacatggcttggatcttgttactttacttcctggtatgattgtcgggcctttcctcggtcccaatctccctatcagtttgtccctcgctctttccatggtgtttggtaatgatgaatacacaaaaataatgagacagacaaatgtagtatacatagacgacatagcttgcgcgcaaatatttcttttggaatgcccaaacgcgaaagggaggcacatttgctctgcacttgatatcacaatccatgatgttgctaaatttatttccttcaaatttccggaacttcaattgcccattagtttattgaaggagattcaagaagaaaagcccattcatgtctcctcagagaagctcttgagtttgggatttaagttcaagtatggttttgaagatatgtatgatggagcaatcaaatgttgcaaagaaaagggttttcttagatga

SEQ ID NO: 533 - DNA, 987 bp, Chelidonium majus
atggaaggtggaagtgatgaaaagaaaggaacagtgtgtgtgacgggtggagctggatacataggctcatggctgatcatgcggctacttgagcgtggctattctgttcgagccaccgttagattggatcctggcctcaacagagatatcagccatcttacaaaccttccaggggcatcagataagctacaaattttcaatgcagatctcaaaaatcctcaaagtttcgatactgcaatagaaggatgtattggcgtctttctcgtagcatacccaggcaacatggatcaaattgaaattgacgatgttgcgaacgaaatgttagaggaagtaaccttagaactactaagagcatgtttgaaatctaagacagtgaaaagagtagtttacacttctagtgcagctgcagttttggtgaatgacaagggtcttatggaaatggatgagagttcatggagtgatgttgaattctgtagaaatgttaaacttcgtggcagttcatatattataacaaagacattaatagagcaagcggctctaaaatttgcagaagaaaatggattggaccttgtgtcgataatacctccgatggtcgttggtcctttcatttgtccacaccttcctgactcggtttctatggctttgtctatcatcttgggtaatcgacatccatatttcgcagtaatgcaaatggtgcatattgatgatatagtctcaggacatatatttctatttgaatgcccgaatgcgaaagggcgatacatctgctcctctatggagacatctgttcatgacatagccaaattttttacaacccattacccagagtttgagctaccaatgaatttgataagtgagatgaaagaagaaaagccaattcacctctctccaaagaagctcttaagtttgggattcaaattcaagtatgatttcaaggatatgtttgatggagcaattcaaagttgcaaagaaaagggtttcttgtag

SEQ ID NO: 534 - DNA, 963 bp, Chelidonium majus
atggcggaatactgtgtaacaggagggactggattcatagcttcttacctagtgaaagctttacttgaaaagggtcacagagttagggcaacagttcgagacccagagaatgtggaaaaggtaggattcctttgggagtttactggagcaaaggaaagactaaagctggtaaaagctgatcttatgatggagggaagctttgacgatgctgtaaatggcgtggatggtgtctttcatacagcatctcctgttaacgtgccttacgacaatgatgttcaggcaactttgatcgatccaagtataaagggaacgatgaatgttctgaaatcttgtgctaaagcaagctctattaagcgagttgtgcttacctcttcctgttctgctgtgagataccgctatgatgttcaacaagtctccccccttaacgaatcgcattggagcgaccctgaatactgcaaaagctacaatctatggtacccatactcaaagacattagccgaagaacatgcatggaaatgggccaaggagagcgggattgatctagtagtggtgaacccatctttcgtcgtgggtcccctgattgcaccatatccaaccagcacactccttatgatattgggaataataaaaggaatgcaaggcgaatatccaaatttcagattgggttttgtacacatagatgacgtagttgctgcccacatcttagccatggaggagagtaaagcatcaggcaggcttatatgttcaagttccgttgctcacttctcagagatcattgaaatgctcaagtccaagtacccatcctacccatttgaaaacaagtgctgtgatcggaaaggagacgacaatccacacagtatggataccagcaagattcgtcagttgggcctccctgcttttaaaactattcctgaaatgttcgaagactgcgtcaaaagcttccaggaaaagggatttctgtga

SEQ ID NO: 535 - DNA, 987 bp, Eschscholzia californica
atggaaggagaaaaaaaggtggtttgtgtaacaggaggagcaggatacctagcatcatgcctcatcatgaaacttattcaacgtggttactatgttagggccaccatccgatctgacccaaaattcaacgaagatgtaagtcatctaaaagctatcccaggagcacaagagaaactagaaatcttcgacgcagatcttgaagacccagaaagtttcgacaatatcatggagggttgtgtcggagtctttcatgtggctcaaccaattgcatttggtgggagtaaagagattttagaaaaaatcattaaaacgtctctagaaggaactctaggaattctaaaggcatgcttaaaatctaaaacagtgaagaaagttgtatatacttcttcaaaagctgcagccttggatttcaaaaatgaagcaaaggagattgacgaaaatacatggacagacgtcgagacattaagaaagaatgaagttggtgatggttggtacccaatttcgaagacattgagtgaaaatgcagcactagattttgcagaagaacatggtttggatcttgttacgatacttccttcgatgattgttggtggcttccttagttcaactctccctctcgctttgaggctttctctcgctttagtcttgggtactgaagttgaatgtcggctacttgcacaagctggaaacgtggtacacatagaagatgtagtttcagctcatatatttttatttgagcgtccggaagcgaaagggagatacatatgttcatcaaacgatatcaccattcatgacgtcgctaagtttatctcagttaaatatccagaactgaaactaccaaccgaattacttgaggagtttgggaaggaaaaggcaatccattattcctcaaagaagctattggatttggggttcaagttcaagtatgggtttgaagatatgtatactgatgcaattgagtgttgcaaagagaagggttttctctag

SEQ ID NO: 536 - DNA, 996 bp, Glaucium flavum
atggaaggaggaggaggagagaaaggtacggtgtgtgttactggtggagctggattccttgcgtcgtggctcatcaagaggcttcttcagcatggatactctgttcggaccactgttcgatctgatcccaaattcaaggaagatatcacccacctccaagtccttccaggggcacaagagaagcttcaaatctttgaagccgatcttgaaaaaccagatagttttgacaacgccatcgacggatgcgtcggggtatttcatgttgcacacccgattgattttgaagggaagatatcccaagacacaatgatcaaaacctctgtcgagggaactctaggcattctaaagtcatgcttgaaggctaaaacagtgaagagagttgtttacacatcatctatgggtgcagccatgtttattaggaacatcaaagatgttaaggagattgatgagagtatgtggacagaagttgatatctttaaacactttgaaggttatggcatgtcctacgcagtttcgaagaccctaactgaaagagcagctatagaattcgcagaagaacatggcttggatcttgttactatacttcctggtatggttgttgggcctttcgatggtcctaatctcccagtcagtttgtccatggctcttgccttaattcttggtaatgaggagctagctaaactaatgagacaggcaaatgtagtacacatagacgacatagcttctgggcaaatcttccttatggaatgcccagaagcaaaagggagacacatttgttctgcaactgatatcacaatccatggcgttgcaaaacttatttccatcaaattcccagaaattcaattgcctattgatttattaaaggagatcgaggaggaaaagcctattcacgtctcctctgacaagctcttgagtttgggattcaagttcaagcatggttttgaagacatgtatgaaggagcaataagatgttgcaaagaaaagggttttctttag

SEQ ID NO: 537 - DNA, 1065 bp, Glaucium flavum
atgcatatatataagaatgaacccagcagatacacatcttctcaatatgagaagggagagagaaggatggaaggagagaaagggatagtatgtgtaacaggtggagcagggcacctagcatcttggttgatcatgaggctgcttcaacatggatactttgttcggaccaccgttcgatctgaccccaaattcaaagaagatatcagccacctcaaatctcttccagaggcagcagagaagctcgaagtattcgaggctgatctcgagaaaccggaaagtttttccgaagccatcaatggttgtatcggcgtatttcatgtagctcatccaatggaatacgaacaaaaagtgtcccaagagacaattatcaaaatctctgtagaaggaactttgggaattctaaagtcatgcttgaaatctaaaacagtaaaaagagttgtctatacttcttctatagctgcagctataagcatgagtaatgatatcaaggagattaatgagaatgtgtggacagaagtagacattgttaaaaatcttgaaggtccaactgtttcatatgcagtgtcaaagacattaacagaaagagcagctcttgagtttgctgaagaacatggattggatgttgtaaccatactgccttctattattgttggaccttccattagtaacaatcttccagtcagtactgctttggctctttcttctattctagatcaagaagagtacaagacattaaagaaagctcctaagccaccagctgcggtgcacatagatgacatcgtgtcagcagaaatctttcttttcgaatcgcctaaagcgaaaggaagatatatttgttccacagtggatattacagcccgcgatgttgctaaatttatagctacaaaatatccagaacttctattatcaacagatttatcaaaggaattcaaagaagaagaagaagaaaagcctgtccacatctcctcagacaagctgttgagtataggattcaagttcaagtatggttttgaagacatgtatgatgatgcaatacagtattgcaaagagaagggtttcctttag

SEQ ID NO: 538 - DNA, 987 bp, Glaucium flavum
atggaaggcggaagagatgacgagaaaggaattgtgtgtgtgacgggtggaacgggatacatagggtcatggctcatcatgcggctccttgagcgtggttacactgttcgagccaccgttagattggatcctggacacaatagagacatcagccaccttacatcccttcccggtgcattagaaaagcttcaaatcttcaacgcagatctccaaaatcctcaaagtttcaatgctgcaattgatggatgtgtcggcgtttttcttgttgcatatcctatcaacttggatcaaatcgaagttgacgatgctgcaaacggtaaaattgtgttggggactcttgaactactgaaggcatgtttgaaatcaaagacagttaagagagtggtttacacttctagcgcagctacacttatggtaaacgacaagggtcttatggaattggatgagagttcatggagtgatgttgagttctgcagaactgttaaggcttatgggagttcatatatcataccaaagactttaatagaacaagcagctctcaaattttctgaagagaatggattggatcttgtgtcgataattccgccaatggttgttggccctttcatctgctctcacctccctggctcaatttctatggctatggctctcattttagggaaccgatatccacgtgtgccaataacacaaatggtgcacattgacgatatagtttcaggacatatatttctatttgaatgccctgaagcaaaagggcgatacatatgctcttccctggagacatcaattcatgacgttgccaaattctttaccatccattacccagaatttgaaatgccaatgaatttgctaagtgagatgaaagaacaaaagccatttcacctttctccaaagaagctcttaagtttgggattcaaattcaagtatggtctcaaagacatgtttgatggagcaattcaaagttgcagagaaaagggttacttgtga

SEQ ID NO: 539 - DNA, 1137 bp, Glaucium flavum
atgggttctttgagtacaactagtgaagatcagaagatgatgagcaagggtccagttgtagtgaccggagccgccggttattgcggttcgtggctagtaatgaggcttcttcaacaaggttatactgtccgtgcaacagttcgagatcccactaaaatcgaaaagacgaggcatttgttggatctaccaggggcggaggaacgattaaccatatggaaggcagacctcgaggacgaaggaagctttgatgaagtgatagacggatccatctatgtcttccatctagccactccaatggattttgaatcaatagatcctgagaacgaagtgattaagcccacaatccatggagttttaaatgtgatgaagtcctgcaagaaagcgaagaccgtcaagcgtgttgtctttacaacttctgctggaaccgtaaacgttgaagagcaccaaaagccagtttacgacgaaacctcatggagtgacattgagttctgtaggcgggttaagatgactggttggatgtattttgtatcaaaatcattggccgagcaagctgcgtgggactttgcaaagaagaacaacattgatctcattagtgtcataccaacactagttgttggtcccttcattatgaatagcatgcccccaagcatgctcacagcgctcgccctcgtcacaggaaatacggcacattattcaattctaaagcagatccaattggttcacctagacgacctgtgcaatgcccatattttcctagcggaacatccaaatgctaagggaagatacatatgctcttctgaagacccaaccatctttcaactagccaacatgctcaaggacagatatccagaatttgacatccctaccaagtttgaaggtatcgacgagtcaatcaaaccagtccatttctcttcaaagaaacttaaagatctgggcttccaattccagtacaccatggaggacatgtatgacggagcgattcagtcgtgcagggagaagaaattgttcccacctggattagaaaaggataggcagaatgaaaagaaggaagttacaagcaaagttgtcaaggaggagaatgagaagatcacatcagttcatgcagtatctcatgcaaaaccagccattatggcataa

SEQ ID NO: 540 - DNA, 993 bp, Hydrastis canadensis
atggaagaagagaaaggaatagtgtgtgttacgggtggagcaggatgtgtagcttcatggctcatcatgaggctccttcaacatggatactccgttcgagccaccgttcgatctgatccaatgttcaaggaagatacaagccacctccttaacctccctgaggcaccagaaaagctacaaatctttgatgcagatcttgaaaatccagaaagctttgaagcagctatcaatggatgtattggtgtctttcatctctctcatcctatggattttgaaggaaagatacctctagacactctaatcaaaacatctatagagggaactctaggcattttaaaagcatgcttgaaatccaaaacagtgaagagagtagtttacacttcatctatttctgcagcaatgtgcatcagtaacatgaatgaaacggggcaaattgatgagagtatgtggagtgatcttgacatggttagaagccataattttcctgcagtttcttatatagtttcaaagacattgactgaaagtgcagttttagagttttcgaaagaacatggattggatgtagtaacaattcttccttcagcaattgctggtccatttctcacttcttaccttccagttgctttctcccagtctctgcctttgatttttggcaaagaagtgcaactcataaacatgacaaatacaaatctagtgcacatagatgatgtagcctcggcacaaatattcctttttgaatgcccaatagcagaagggagacacatttgttctacaattgatctttcaattcatgggttggcaaaactactttctaacaaatatccagaacttgaacttcaaattccaaccgatgatttaagcaagatggaagaaacaaaacctcttcacctctcatcaaagaagctcttaaatttgggattcaagttcaaatatgatctggaggagatgtttgatggaactattcagtgttgcaaagagaagggttttctttag

SEQ ID NO: 541 - DNA, 1062 bp, Hydrastis canadensis
atggtagcagagggtgactctgtttgtgtcaccggagcagcgggtttcattgggtcatggctggtcatgcggcttctcgaacgaggttacatggttaaggccaccgtgcgtgatcctgacaacataaagaaggtgaagcatctgctagacttaccaaatgctaaaacaagcttgaccctatggaaagctgatcttgtagacgagggaagcttcgacgacgcgataaaagggtgcaccggagtatttcatgtggctactccaatggattttgagtccaaggaccctgagaatgaagttataaagccaacaatagaagggatgttaaatgtgatgaggtcttgtgttaaggctaaaacagttagaagacttgttttcacttcatctgcaggaactgttaacgttcatcaacatccacaacagccaaagtatgatgaaaattgctggactgatgtagaattttgcaggaataagaagatgactggatggatgtatttcgtctccaaaactttggctgaaaaggcagcttgggaatttgccaaagacaacaatttagatttcatcagcattataccgacactcgtcgttgggccctttctcatgtcatcaatgcctcctagtcttataactgctctttcaccaattactggaaatgaagctcattactcaattttaaaacaaattcagttggtccatctagatgatctttccaatgctcatatttatttgtttgagcatccagaagcaaatggcagatatatatgctcttcttatgattccaccatcattgatgttgccaatgtgcttagacagaaattcccagagtataatgtccctaacaagtttaaggatgttgatgaaaatttgaaggcagtggcattctcatcgaaaaggctcatagacttgggattcaagtataagtacagcaaggaggacatgtttgtagaggccattgtttcatgtagagaaaaggggttacttcccctttgcagtgaaacacaagttaatgacaagagcatggaatgtgagaaacgagaagcgagaagcgaaggcggttcagattga

SEQ ID NO: 542 - DNA, 954 bp, Hydrastis canadensis
atggaaagagtgtgtgtaactggagctggaggatttcaggcgtcttggctcgtaaacttgctcctatctaaaggttacatggtccatggaacagtcagaaacccagacgacgaaaagaatgctcatttgaaggaactagaaaaagcctcagaaaacttaaagctcttcaaagctgacttgttggattacgacagtctatttgctgccattaatggatgcagtggtgtcttccatgttgcaagtccagttccttcaggcgctgtacccaatcccgaggtagaattgattgagcctgccgtaacaggtacatctaatgtactaaaggcgtgttccatggcaaagataaagaaagttgtgtatgtatcatctattgctgctgttatgctcaatccaaattggccaaaggataaactcatggatgaatcatgctggtcagacaaggaattctgcaagacaactgagaactggtattgcctatccaaaacagaagcagaaagtcaagccttagattatgcaaagaaaagtggactcgaggtcgtaacagtttgtgcatccatcatcattggaccaatgttgcaatctaaaatgaatgctagtagtttgcttcttctcaggatgttgaaagatgggttggagacactagataacaaaattcggatgtttgtcgatgtgcgtcatgtggctgaagcactattgttggtttacaagaagcctgaagctgaagggagatatatatgttccgcattcacacttacaatgaaggacttgaacgaaaaattgaagactatgtatcctaactataattatcctaaacaaattgttggggttgatgaagcttgggatatcagttcagaaaaattactgaatctgggatggaagtatagaccattggaagatacccttattgactcaataaaaaattatcaagaaaaagggctcttacataaggtatag

SEQ ID NO: 543 - DNA, 981 bp, Jeffersonia diphylla
atggaagggaagacaggaactatgtgtgtgacaggaggagctgggtacctgggttcatggttggttatgaagcttcttaagcgtggttattctgttagagcaacagtcagattagatcctgagcacaagaaggacctcagccatctcaaaaacctcccaggagcgtcagaacaccttaaattttttaatgcggacctcaacaaaccagatagcttcgatgctgccatcgaaggatgtgatggtgtctttcatgtagctcatcccttagatttccaaggaaacgaagcagatcctgctaggatcagtatggcagtagaaggaactcttgggatacttaaggcatgtgtaaactctaagacagtgaagagagtcgtgtacacttctagcgtggctgctgttgttttaaatacaactgggctgatggaaatggatgagaactcatggacagaccttgaacttgttgaaactattaaagctcctggaagctcatatattgtaccgaagacattagcagaacaagctgctataaaatttgcacaagaacatggattggatctgatcacggtggctccttctttgattgttggtccgttcatttgtcctcattttcccacttctgtgttcctggccttagccgtacttatgggtaagaccgataagtttcaatacattagcataaccagtatggtgcacatagaagatatagtggcagcgcatatattccttctcgaatgcccgaatgctaagggacgttttatatgttcagcgcttgatacgacaatccatgacttggctaagtttctgtctagcaagtacgaagattttgaaatgccaatagattcactgaaggagatagaagaaaggaagccacttcatctctcttcaaagaaactgctagacttaggattcacatacaagtatggccttgatgaaatatacgatggagcgattcaatgttgcaaagagaaggggttaatgtag

SEQ ID NO: 544 - DNA, 1002 bp, Jeffersonia diphylla
atgccaaagaaggcggcggtcgatcagaagatggacttcaaaggcaaagtatgtgtgacaggggcctcagggtatctggcttcttggttggttaaacgactcctcctgtctgggtatcatgtgaaaggaacagttagagacccaggaaatagcaaaaaattggcgcatctttggcaactggatggagcaaaggagagacttgaattggtgaaagctgatctgatggaggatggcagctttgatgatgccataatgggctgttgtggtgtcttccacactgcatctcctgtcttgggccctgagtctgatccaaaggctgaaatcctggatcctgctgttaatggaaccctaaacattctgaggtcgtgcaaacggaatccaggtcttaagcgtgtcatactcacgtcttcctctgcagctgttagggtcagagatgattttgacccaaacattccattggatgaaacgtcttggagctcagtggaaatctgtgaaagattccagatttggtatgcattatcgaaaattctagcggagaaggcagcatgggaatttgctaaagaaaatgggattgacttagtcactatcctgccatcattcttaattgggccaagtctgccacatgatttgtgttccactgcatcggatgtccttggtttacttacaggtggtccgaataagttctcctttcacggtaggatgggctacattcacattgatgatgtggcactctgtcacatccttcttttcgaggaagccaaagctcatggaagatacctctgcagttcctttgtgatggataacaatgatctggcatcttttctagctcagcgctatccatacttaccaataactaagaggtttgagccacttgatagaccatgctatgaattcaatacatccaagatgaagagcttgggcttcaaatttaaagggattgaagaaatgttcgacgattgtgtagcatcactcaaggagcaaggctatatactccagaaataa

SEQ ID NO: 545 - DNA, 984 bp, Jeffersonia diphylla
atgagtatcggagcagggaaggtggtatgcgtaactggggcatctgggtacatcgcttcatggctagtgaagcttcttctggaacggggttacactgtcaaagcctctgttcgtgatcccaatgattacaacaagactgtacatttgcgtgcactctctagagccaatgaaaggcttcaattatttaaagcaaatttactggaagaaggatcctttcattctgtaattgatgggtgtgaaggtgtttttcatacagcatctccattttttcataacgtcacagatccacaggctgaattaattgatcctgcagtgaacggaactcttaatgttcttggttcgtgtgcaaaaattccaacagtcaaaagagtggttgtaacatcatcagcagctgcagttgtttataatggaaaaccacggacccctgaagtggtagttgatgagacttggttctcggatgcagaattatgcaagaatctcaagctttggtacgtagtttcaaagaccttagctgaagagtctgcttggaaatttgcagaaaaaaatgggattgatatggttgcaataaatccagcaatggtgattggtccactattacagccgacacttaatacaagtgctgaagctattctgaacataataaaaggaggggaaacttttcccaatcgcactcttggatgggtccatgttaaagatgttgccaacgcacatattctggcctttgagaattcctcggctactggacgatattgtttattcgagagtgttgctcactattctgagctagttaggattctacgtgagctttatcctggtctgaagctccctgagaaaagtgaagatgacaagccatttgcaccgacatatcaagtatccagggagaaagctaaagggctgggcattgatttcattcctttggagattggcctcaaggaaactgttgaaagcttgaaagagaagaagtttgtcagttttgaagtttag

SEQ ID NO: 546 - DNA, 978 bp, Menispermum canadense
atgagcagtggagcaaagaaggtggtgtgcgtgacgggagggtctggctacatagcttcctggcttgtgaagcttctgcttgagcgaggatacactgtcaaggcttctgtgcgggatccaaatgatccaaagaagattggacatttacttgctcttcctggggctaatgaaaggcttaaattgttgaaagcagatttattggaagaaggatcttttgattctgtgattgatgggtgtgaaggtgtctttcatacagcatctccatttttccacgcagtcacagatccacagactgaactaattgcccctgctgtgaaagggactctcaatgttcttagttcttgcgcaaaaactccatctgttaaaagagtagtcgtgacgtcctccatggcagctgttctctactatgggaaacctcgaactccagaggtggttgttgatgagacttggtattctgatccagagttttgcaaggaatcaaagctctggtatgtagtgtcaaagactttagctgaagaagctgcatggaaatttgcaaaagaaaatggacttgatatagtcacaataaatccagcaatggtgattggttcgctgctacaaccaactttaaatacaagtgcggcagctgttctgaatttaataaacggatcagaaacatttccaaattatacttttgcatgggttcatgtgaaagatgtcgccactgcccatattctggcatttgagactccttcagcgagtggaagatattgcttagttgagagggttgctcattattcagatgtcgtgaaggttttgcatgacctctatcctaacctgtcacttcctcagaagtgtgcagatgacaaaccatttgtaccgacttaccaagtctcgattgagaaagccaaaggcttgggcattgatttcattccaatggaggtgagcctcaaggagacggtcgaaggcttgaaggagaaaaacatgatcagtttctga

SEQ ID NO: 547 - DNA, 966 bp, Menispermum canadense
atggagggagcgaacgaaagagtgtgtgtgacaggtgctggtgggtttgtggcatcctggctggtgaagcttctcctctctaagggctacaccgtacatggaactgttagagacccaagagataaaaaaaatgctcacttgatgaagcttaaggaaggctatgagaagctgcagctcttccaggcagacttgatgaattacagttctctttgtgcagccatcacaggttgcaatggagttttccatgttgcaactccagttccaccaggctctgacgcagttcttgaggctgaattggttgagccagctattgtgggtacactaaatgtacttaaagcatgctctgaagcaaaagttaagagagttgtggttgtgtcatcttcggctgctgttgaaatgaatcctaattggccaaaagatcaagttatggatgagacatgttggtccgacaaggaatattgcaaacaaaccaagaactggtattttttctccaaaacagtagcagagaacgaagccttagagtattcaaagggaactgggttggatgttgtgacagtttgtcccagcattgttattgggcctatgctgcaatccactgtaaatggtagtagcttggttctcatcaagattttgaaagatggaattgatagagtagaaaacaaagtgcgtatgcttgtggacgtacgtgaagttgctgaagcactgcttctgacatataagaagcccgaagcccaaggcagatacctatgtgtgtcatacatgatcagaatgaaggatttggtggaaaagctaaggagcgtgtatcctaattataattatccaaagaattttaccgaggttgaggaggaagacaagctgagttctgcaaaactgcagagtctgggatggaaatttaggccactggaggagacacttgctgattctgttaagagctaccaagaggctggtattctagacaaggattag

SEQ ID NO: 548 - DNA, 990 bp, Nandina domestica
atggaaggaggtgataagggtacagtgtgtgttacaggtggagctggattccttgcttcatggctcattacgaggctccttcgacatggttactctgttcgagctactgttcgatctgatccaaaattcaaggaggataccacccacctcatgaacctccccgaggcacaagaaaaacttgcaatcttcgatgcagatctcgagaagcctggaacttttgaacctgtcgttgagggatgtattggtgtttttcatgttgctcatcccatggacatggaagggaaaacaccccaagaaacaataaccaaaatctctgtagagggaactctaggacttctgaatgcatgcttgaaatctaaaacggtgaaaagagttgtatacacttcatctacagctgcagctatgtgtgttagtaatttgaaggaacttcaggaaatagatgagaacatgtggtcagatgttgagatgctcaagggtttgagccttcctggactttcttactctatttcaaagacactcacagaaagagcagcaattgagtttggggcaaagaatggattggatgttgttacattgcttcctgctgcaattgtgggaccattccacactcctaatatccccattggtgttgctctggctttggctttggtatttggtaacgaattagcgtgtcaactcgcaaaacaattaaacattgtccacatagacgatgtagcctctgcgcaaatcttccttttggaatgcccaaaagcagtaggcagacatatttgttcatcagctgatactacaattcatggattagccaaatttttctctgccagataccctgaattccaaatgccaattgatttgttaagcaaaatggaagaagaaaagcctattcacctttcctcaaagaagctcttggatttggggttcaaattcaacaatggtatagagaagatgtatgatggagcaattgagagttgcaaacagaaaggttttctttag

SEQ ID NO: 549 - DNA, 999 bp, Nandina domestica
atggaaatggaaggagagaaagggagtggtagtagagttgtatgtgtaacaggtggaggaggatatatagcatcatggctcatcatgagactccttcaacttggttactctgttcgagccactgccagattggacccaaaattgaagaaagacctcagccacctcacaaacctcccaagagcatcacaaaacctcaagatcttcaacgcggacctaaaccaaccagacagcttcactgctgccatcgaaggttgtgatggacttttccacgtagcgcacccccttgatttggaagactgtgaagttgacgatgcaaaggtgaatatgttagttgaaggaactctaggggttctcaaggcgtgtgtgaagtctaaaacagtgaagcgagttgtctacacttctagtgtggctactgttgttgctaacaaaactgggctcatggagatggatgaaagcatatggagtgacattgattttgttaaagcttataagtttcctggaagctcatatgttgcggctaagacattatcggaacaagcagcgattaagtttgctgaagaacatggtttggaacttgtgacagtgatttcttcgatggtcgccggtccattcatttgtccttcattgcccagctcagtgtgcatggctttggcattgatcatgggtaagagtgatcaatatatcaatcttgttaaggcaaatttggtgcacatagatgatatcgttgctgcacacatattcctcctggaatgcccaaaagcgaaaggacgttacatatgctcagcaattgatacaacaatccatgaattagctaaatatctctcattcaagtatccagaatttgaaatgccgatggattcgctcaaaggggtaccagaaatgcagccaattcatgtctcttctaagaagttgatggatttgggattcaagtttaaatatggtttggatgaaatatttgatggagcaattcaaagttgcaaagaaaaagggtttatgtag

SEQ ID NO: 550 - DNA, 921 bp, Nigella sativa
atggctgatgaggaacaacctagtaccaaattgagggcttgtgttattggaggaactggatacctggcgagtttcctcatcaagcacttgctgcagaaaggttatcatgtgaactctactgccaaagatccaggtaatccagaaacgatctcccaccttttggagttgcaaaatttgggtgagctgaaaatattcagagcagatttaactgatgaaggcagctttgatgaggcagtatctggatgcctcgtagtgtttcatgttgcaactccagtgcactttgattctgaagatcccgagaatgacatgatcaaaccagcaattcaagggacactaaatgttctcaaggcatgcacaaaggcacagacagtaaagcgtgtggttatgacatcttcggcagcagctgtgtccataaacaatattaataacacagatccggtgatggatgaagaatggtggaccgatgttcaatacttgtcttcagagaagccatttgcttggggatatccagtctcaaaggccctagcagagaaggcagcatggaaatatgcagaaaacaatgaaatggaccttatcactgtcatcccttctgtaatcgcaggtccatctcttactccaaatgttccaaacagcgtaagccttgccatgtcattgcttacaggaaatgaaagcctgatcaacggtttaaaaggaatgcaaattacatcgggttcgatttcactgttacacatagaggatgtggtaagagcacatatatttgtagctgagaagcaatcagctacaggtcgatacatttgttctgctgtcagtaccagtgttcctgagcttgcaaaatttctgagtaaacgatatccacaatatgtagttctttcagaacgagcctgtagctgcgaagtagtatcgggaggaggagttttatga

SEQ ID NO: 551 - DNA, 993 bp, Nigella sativa
atgagtagcagtactactactgaaggtgcagggaagacagtgtgcgtaacaggtggttctggatacatagcttcatggcttatcaagcttctgcttcaacgtggttacactgtcaaagctactgttcgtgacccaaatgatcctagacagaccatgcatttacgtgaactttgtggagctggtgagcgacttagtttgttcaaggcagacttattgagtgaaggtgtttttgactccatagtcaatgattgcgacggtgttttccatacagcatctccctgctattttgaagccaaagatccacaggctgaaatagttgagccagcggtgaagggaacacttaatgttctcagatcttgcactaaatcaccctcagttaaaagggtgattgtgacatcctctattgctgcagttctgaacaatgggaagcttcgaactcctgatgttgttgttgatgagacatggttttctgatccagaagtctgtaaggaattgaagctttggtatccactctctaaaaccttagcggaagaatctgcttggaagtttgcaaaagatcatgggattgacatggtttccataaaccctgcaatggtgattggacctcttttgcagccaacacttaattcaagttcttcaatcattctgaatctgataaacggagcgaaaacatatacgaacgcagcttatggattggtagatgttagagatgttgcaaatgcacatattctcgcatttgaggttccttcagctactggaagaatttgtttagctgagaaagtttgtcacttttcagagatggtggagatcttacatgagctttacccagacatccaacttcctacaaaatgtgccaccgatgagccatttgtccaaccctatcagctttgtacagagaaggccaggagcttgggcattaattttactcccattggagtcagcctcaaggaaacggttgaaagcttgaaagcaaagaagtttgtcaacttgtga

SEQ ID NO: 552 - DNA, 960 bp, Nigella sativa
atgcctgagtattgtgtaactggaggtactggattcatagccgcttacatagtgaaagaactgctccacaaaggttataatgtcagggcgacagtccgggacccaggggatgcagagaaggtcgggttccttctagaaatggatggagcaaaggaaagactcaagctggtaaaagctgatctcctggaagatggaagctttgatgatgcggtgcaaggagtagatggagtcttccatacagcatctccagttcttgttccctatgacgagaatatacaggaaactttgatcgatccatgcatcaagggaacagtaaatgttctcaagtcctgctccaaagcaagctcagtgaagcgggtggtactcacttcttcatgctcgtctataagatattgtgacgaagcgcaaaaagcgccccttaatgagtcccattggagtgatcctgagtactgcaaaagctataatctctggtatgcatatgcaaaaacattgggtgagaaagaggcttggcgactgtcaaaggagcttggaattgatctagtggtggtgaacccatcttatgttgttggtcctctgattgcaccacaaccaactagcacactcctcatgatactggggatcataacaggtgtaactgatgaatatccaaatacaatgattggttttgtacacattgatgatgtggtccgtgcacacattttggctatggaagaaagcagagcagcaggcaggcttatatgttcaagctcagttgtccactggtcagagatcattaagatgttaaaagacaagtatccatcctacccaatgccaacaaagtgctctgacaagaaaggagatgataccccacattccatggacaccagcaagatcaatgaattggggctcccagctttcaaaacagtccctcaaatgtttgatgattgcatcaagagctttcaagagaagggatttccgtga

SEQ ID NO: 553 - DNA, 1026 bp, Sanguinaria canadensis
atggaaatggaaggagagaaagggagtggtagtagagttgtatgtgtaacaggtggaggaggatatatagcatcatggctcatcatgagactccttcaacttggttactctgttcgagccactgccagattggacccaaaattgaagaaagacctcagccacctcacaaacctcccaagagcatcacaaaacctcaagatcttcaacgcggacctaaaccaaccagacagcttcactgctgccatcgaaggttgtgatggacttttccacgtagcgcacccccttgatttggaagactgtgaagttgacgatgcaaaggtgaatatgttagttgaaggaactctaggggttctcaaggcgtgtgtgaagtctaaaacagtgaagcgagttgtctacacttctagtgtggctactgttgttgctaacaaaactgggctcatggagatggatgaaagcatatggagtgacattgattttgttaaagcttataagtttcctggaagctcatatgttgcggctaagacattatcggaacaagcagcgattaagtttgctgaagaacatggtttggaacttgtgacagtgatttcttcgatggtcgccggtccattcatttgtccttcattgcccagctcagtgtgcatggctttggcattgatcatgggtaagagtgatcaatatatcaatcttgttaaggcaaatttggtgcacatagatgatatcgttgctgcacacatattcctcctggaatgcccaaaagcgaaagggcgttacatatgctcagcaattgaaacaacaatccatgaattagctaaatatctttcaatcaagtatccagaatttgaaatgccgatggattcgctcaaaggggcaccagaaatgcagccaattcatgtctcttctaagaagttgatggatttgggattcaagtttttaatggtttggatgaaatatttgatggagcaattcaaagttgcaaagaaaaagggtttatgtagatgtcttctagtactcgaattgccatag

SEQ ID NO: 554 - DNA, 1140 bp, Sanguinaria canadensis
atgggttctaccactcatgatcaagatgatcagatgatggtgatgatcaagggtcctgttgtagtgaccggagccgccggttattgcggttcgtggcttgtgatgaggcttcttcaacaaggttatactgttcgtgccacggttcgcgatcccactaaaatcgaaaaaacgaagcatttattggatataccaggggcaaaagaacgattaaccatatggaaagcagaccttgaagacgaaggaagctttgacgaagtgatagaaggatccatctatgttttccatctagccaccccaatggactttgaatcaacggatcctgagaatgaagtgatcaagcccacaatcgatggagttctaaatgtgatgaaatcgtgcaagaaagccaagactgtaaagcgtgttatattcaccacttctgcaggaacaatcaacgttgaaaaacaacaaaagccaatttacgatgaaacctcatggagcgaccttgagttctgcaggcagaccaagatgactggttggatgtattttgtgtcgaaaacattggccgagcaagctgcatgggactttgctaaggagaataacattcatttcattagcgtcataccgactctagttgtcggtcccttcatcacgaataacatgccgcctagcatgctcaccgcgctcgccttgatcacaagaaatgaagcacattattcaattctaaagcaaattcaatttgttcacctagatgacttgtgcaatgcccatattttcctagccgaacacccaaaagctgagggaagatacatatgctcttctgaagaccccaccatcttccaactagccaacatgctcagtgccagatatcctgaatttgacatccctaccaagtttgaaggtattgatgagtcaatcaagcccgtccatttttcgtcgaagaaacttaaagatctagggttccaatttaagtacaccatggaagacatgttcgatggagccattcaatcttgcagggagaagaaattgttcccatctgacttagaaaagaataatcaacactttgattatcagaaggaaattatagacctagcagcagccaaggagaagattcagatctcgtcagtgccagctccagaaaaaccaaccattatggcatag

SEQ ID NO: 555 - DNA, 1020 bp, Sanguinaria canadensis
atggattggaaggtgatcggaaagaagacggtatgtgttaccggtggcaccggttatgtcgcctcgttactcattaagaacttgctagagaagggtacttatgctgtcaatactactgctaggaatccagaggatcagaaaaaggttgctcatctcttaattctacaagcagatcatagtgacttaaaaattttccgagcagatttaaccgatgaggggagctttgacaccgccatcgctggctgcgatatcgtctttcatgttgcgactcctgtgaactttaattcacaagaccctgagaatgaaatgatcaatccagccatccacgggacgctcaatgtgttgaacgcgtgcgtgaaatctaagacagtgaagcgcgtggttttgacgtcgtcggcagctgccgtgtctataaataatcagaacggaacaggttttgtgatggacgaaggatgctggacggacgtcgagttcttagcttccgcaaaaccacctatttggggatatccagtgtcaaaaacacaagcagagaaggcagcctggaaatttgcagaagaaaacaagatagacctcatcacagtcatcccttctctaatgctgggcccatcacttactcttgctgtcccctccagtatctttcttggaatgtcattgctcacagggaacaatgaactgatcaacaccttgaaaggcatgcaaatgctatcgggctcgatctcgataacacacgtagaggatgttgttaatgctcacatatttctagctgagaaggaatcggcttctggccgctacatttgctgcaacatcagcagtagccttcctgagctggcgaagttactcagcaatcgatacccacagtacaaagtccctactgatttcagagattttcctacaaaggccaagctgagtctttcatcagaaaagcttattaacgaagggttcagcttcaaatacggaatcgaggaaatttacgatcaaaccatggagtactacaaatctgtagaacttctgcagaaatga

SEQ ID NO: 556 - DNA, 966 bp, Sanguinaria canadensis
atggcggaggagtactgtgtgacgggagggactggattcatagcggcttacatagttaaagcattactggagaaaggccacagggttagggcaacagtgcgagacccagacaaggtggaaaaggttggattcctttgggagtttactggggcaaaggaaagattaaagctggtaaaagctgatcttatggtggaggggagcttcgacgaggccatagatggcgtggacggtgtcttccatacagcatctcctgttctcgtgccttacgacactgacattcaggcgactttgatcgatccaagtataaagggaacgatgaatgttctgagatcctgctctaaatcaagttcccttaagcgagttgtgcttacctcttcttgttctgctgtgagataccgctatgatgttcaacaagtctcccctctaaatgaatcacattggagcgatcctgaatactgcaaaagctacaacctatggtacccgtacgcaaagacattagccgaggaacaggcttggaaattggccaatgagagtgggattgatctagtagtagtgaacccatcttacgtcgtgggtcccctgattgcaccatatccaaccagcacactccttatgatactgggaatcataaaaggagtgcaaagcgaatatccaaatttggcagtgggttttgtacacatagacgatgtggtagctgcccacatcctagccatggaggagagtaaagcatcaggcaggcttatatgttcaagttcagtcgctcacttctcagagatcattgaaatgcttaagtccaaatatccatcctacccaattgtaaacaagtgcaatgacaagaaaggagatgacattccacatagcatggacaccagcaagattcgtcagttggggttccctgcttttaaaactattcctgaaatgttcgaagactgcatcaaaagcttccaggaaaagggatttctgtga

SEQ ID NO: 557 - DNA, 1125 bp, Stylophorum diphyllum
atgggttctataaatatagatccgacgatgatgaagaaagggcctgttgtagtgactggggctaccggttattgcggttcgtggcttgtgatgaggcttcttcaagaaggttatattgttcgtgccacagttcgcgatcccagtaaaatcgaaaagacgaagcatttactgggtctacctggggcaaaggaacgattgaccttatggaaagcagaccttgaagacaaaggaagctttgatgaagtgatagagggatccatctatatgttccatcttgccactccaatggactttgagtcaacagatcctgagaatgaagtgattaagcctacaatcaatggagttctaaatgtgatgaagtcgtgcaagaaatctaagaccgtcaagcgtgttatcttcacaacttctgcgggaaccgtcaatgttgaagagcaccttaagccagtttatgatgaaacctcatggagtgatgttgagttctgcaggcggatcaaaatgactggttggatgtattttgtgtcaaaaacgttggccgagcaagctgcgtgggactttgctaaggagaacaacattcatctcattagtgtcataccaacactagttgtaggtcccttcatcatgaatagcatgccacctagcatgatcaccgcgctcgccctaatcacaggaaataaagcacattattcaattctaaagcagattcaattagttcatctagacgacttgtgtaatgcccatatttttgtcgccacacatccaaaagccgagggaagatacatttgctcttctgaagaccccaccatcttccaactagccaacatgatcagagacagacatccagaattcgacatccctacaaagtttgaaggtatcgacgaggcgattaagccaatacatttctcttcgaagaaacttaaagacctagggttccaattcaagtacactatggaagacatgtacgatggagccattcagtcgtgcagggagaagaaattgttcccacctgagttggaaaagaataagaagcagtatgatcatcagaaggaagtactagtcaaggagaagaagatctcaacagcagtgcccaatgcagttctacaagagatagaaaagaatattaattag

SEQ ID NO: 558 - DNA, 963 bp, Stylophorum diphyllum
atggcggaatactgtgtaacaggagggactggattcatagcttcttacctagtgaaagctttacttgaaaagggtcacagggttagggcaacagttcgagacccagagaatgtggaaaaggtaggattcctttgggaatttactggagcaaaggaaagattaaagctggtaaaagctgatcttatgatggagggaagcttcgacgatgctgtaaatggcgtggatggtgtcttccatacagcatctcctgttaacgtgccttacgacaatgatgttcaggcaactttgatcgatccaagtataaagggaacgatgaatgttctgaaatcttgtgctaaagcaagctctattaagcgagttgtgcttacctcttcttgttctgctgtgagataccgctatgatgttcaacaagtctccccccttaacgaatcgcattggagcgaccctgaatactgcaaaagctacaatctatggtacccatactcaaagacattagccgaagaacatgcatggaaatgggccaaggagagcgggattgatctagtagtggtgaacccgtctttcgtcgtgggtcccctgattgcaccatatccaaccagcacactccttatgatattgggaataataaaaggaatgcgaggcgaatatccaaatttcagattgggttttgtacacatagatgacgtggttgctgcccacatcttagccatggaggagagtaaggcatcaggcaggcttatatgttcaagttccgttgctcacttctcagagatcattgaaatgctcaagtctaagtacccatcctacccatttgaaaacaagtgctgtgatcggaaaggagacgacaatccacacagtatggataccagcaagattcgtcagttgggcctccctgcttttaaaactattcctgaaatgttcgaagactgcatcaaaagcttccaggaaaagggatttctgtga

SEQ ID NO: 559 - DNA, 966 bp, Stylophorum diphyllum
atggctaaaggcacggtctgtgtaactggtgcatcgggtttcctggcttcttggctcatcaagcgacttctgttatctggctatcatgtcgttggcactgttagagaccctggaaatgacacaaaactggctcacctatggaacttacaaggagcaaaggagaggctccggctagttaaagccgaattaacagaagagggaagctttgacgatgcaatcaaggggtgtgagggtgtctttcacatggcttcccccgttcttggacagcctactgatcctcaggacatcttaaagccagctattgatggaactcttaatgtgttacgttcgtgtaaaaagaatccgtcactaagacgagtggttctcacatcatcgtcttccacaatcagagtaagagaaaagttagaccccaaaaatcctttggacgagtcatcttggagctcagttgaactctgttctaaactcaagatttggtatgtactatcaaaaacaatggcagaaaaggcagcatgggagttctgtaacgaaaatgggatcaatctagtgacggttagcccttcatttgttgtaggaccaagcttaccacctgctttatgctctacagcatcagatatcttgggcttgcttcaaggtgaaactgagaggttttattggcatggaaggatgggatatgtccatatagatgatgttgctctatgtcatattctagtttatgaacgtgaagaagctgaaggacggtatctatgcagctcgactgtcgttgataatgatgaactcgtgtcaattctgtcagcacgctatcctacactacctataccaaagaggtttgagcagcatgaaagaccctattatgacttcaacacgaacaagattaagagtttagggttcacattcaaatcgattccagagatgtttgacgactgtatcacatctctagtggcacaaggccatctgtcgataccttag

SEQ ID NO: 560 - DNA, 1522 bp, Berberis thunbergii
accccctatacagtatatggatttgcaaatttcatctcatgttgcagtataatttggcatatgtgagatgaaacagagttttcgtaaatttgacatggacgactcacaaacatatcttcttaaagcataacagatagtcagttacaaataccctgtgcaacacactatgcactaggagtcgtggatacatattcaagaagcttttcatcttgttcgaactcagccatgtcttcatctaacatgttcacccatgcttctatgccatctccggtccttgtatccatcaatataataagatccctacaaggaaaaccacttatgcttacccatgtaggttttccccaaccaaagtcagtttcgtaccaaggaaacctacaccaactactgaatatagccaaacccgtctcacctttggcaactcctgctagtccacccaagaacgattccaagtaggcattaccacatagtattcttctcaaatacttgccatcaattttacttatagcatccctgagcttgcttacaagtatgtgaggctctttcttgccatccaaatcctgacttgccgtgaaggttgatccaaatacatttcctaaggtgttctcaagtccttcaaccttcaatggtggatccattctcctccgaaagttgactgcatgtattgctacatattccttcaagagtccatttttagctcgagttgattccataaaacgcctccatatcaaggctgacacggcttcaatgcgtgtgggatatgagacatgtgagctattagcccccgttgcccttagggatgctatctttgatgcatcaaatacaaaccttttggttacaatctttcctttacctctatgaatgaatgcggatggaatgtaaccaagtaaatctctctgagggaaaatagaggagagctcagagatgggaaggatttcttctttacaattgtgagtttttgcagcccaacaattgatgaatttgctcatggaataagcatcagaaatcttatgtgacaagcacacacatatcattatccctccacaatcaaatacattgacttggatggctaagagtactttggacccaaacttaggtccatgtgcagtatcagcatcatcaaaatggggttcatcacatggtgagaacatttttagtacatcagcaacatttggttgcacaatcacttctgataatagaccgctgacacgagcttctacatagttagcaccttcatcattgcagtcgacagaggtattaccatttatcctccctgctaacgggtagaagctagttaatgtttctgatagagatctcttttggcgacaatgtaaaccagcgttttcaatgtcattgggactgttgtcagcatagaaaaggaagataggaatataaaatggaggagcaatctgatcaaggaagcagaggttgaaggttttaaggtaaggaggagttggagaggatggcttgatggactctcttgagataacttgaaccttcatcttcatcttagagttaaggagac

SEQ ID NO: 561 - DNA, 1984 bp, Corydalis chelanthifolia
aaaatcaatatatctaaaaaaccaattgttaaaacgtccacattacttttgcaccatttgatggttaggagaaggtgcaatgcgctcaccaattcagagatttcaacgccagaagaagaagaagaagaagaagtgggtgtcatatgtttgttatacatccagctaagttgttgttgttgttgcatttgccaaaaactactcaccgatcacaagctagcaactgctttcgttaatggagtatagcagctattaagcaagcttgctctcagtctcatctggaaggaagctcacctatcacaactgcttcaaaggccggaaataaattagagatggcggattcaaaatcatcatctgtagtggaagtcatctccaaagagaccatcaaaccatcaattccaacaccagagcatctcaaaactatcaaaatctccctccttgatcaactctctcctccactctatgtacccatcattctcttctacacagctgctgctgctactgatgatgatgataaagaaatctacgaaaatctcgaatataaatccaatatactaaagaaatctctatcagaaacattgacgcacttctacccgttggccggaagaatgaaagataacatggtgatcgattgtaacgacgaaggtgttgactatttcgaagcacgagtcagtggaaacatgtcagaattcatgaaaccagatgcagtgcctcaatttcttccttatgatgtcatgtaattactcgggtaatggtaagatacaacttggtgttcaagttaacaagtttgattgtggtggaatagccattggtgtatgcatctcacacaaaacagcggatgcatcatcaatgagtgcattcatcaatggttgggcttccaccgctcgtaccggtgccaccgaatctccaacatttgatttggttcatctgtacccaccttcttgtgtacaaatacccagtgagaactccttcacaacacaagtagaaggagagaaggttgtcacgaaaagattcgtatttgatgcatccaagatagccaacctccgagccaaattaggagatgatgatgatgataagaagacaattacacgcgtccaagccgtgacgggacttatttggaaatgtgccatgtctaaatgggcacatacttcctcttcaaccagttccaaactatccatagcgaatctcgctgtgaacatacgatggaggatggacccaccgttggatcaactgtcatacggaaatttactcacactagcaacagcagcatcaacgacggagggtggatcattggaggaattagtgggccaattgaaggttgctctgagtaaaattgatgctgaaactatcaagtacattcaaggtgaaggaggattcatgaggcttcaagagttactagggagggtacatgagatgtttgccaaaggtgatgaggttgaggtttatatgtttagcagttggtgtagatttcctgtttatgaagctgatttcggttgggggaggccgacctgggtgagctgcagcagtcaaccatacaagaatactgtgatattgatggatactagaagtggcgatggaattgaagcgtgggtgaatttggttgaggatgacatgactctgtttcaacaaaatcaagaacttcttgaatttgttagctacaccgatatttgaccataactgttattcgatattttgcatgcttcaaagtcagagttaactcggtgcgccagccgcccgatcaacctgcctcaattaattgtttgggaactagctagctagctagctaggaaactggttagtcagtattcgttgatctggctgctggcttttgggaattctgtctatagttgtgatgagtgaattgtttgtgttgaggtattcaaatttgatgtagttaatttagaaaaagttaggtttaatttgttttaatattttgcttattattctttaatgaagttgcttaattgtttggcattgtatatcttat

SEQ ID NO: 562 - DNA, 943 bp, Chelidonium majus
gcctaaaattgaaaataagagaatacaaagtaacaagaacataccgtaagagtacaataccgagaaatccgacaagaaaaagagaaggattaccggagtaagacaaatacaagtatgaaaacaagagaataaagatggtagttaagatggacaaacacgacaattgacctctattagggaaacggttgaaaatcaaaacagttggaggatctctcttaggtggtgttcgaacttggtcagaaaaccatgttcttgtactttggctcaattaatggaacagtagttacccaaactggcgttccccaaccaaaatcagcttcgtagaatccaaacttgcaccagctagtcataaacaaagctgtcaccttatcttcaacatcactgtctttcgctacggaagcatcatgaccatagatgaacttttgaatgattttctccatgcaacctttatcaccctttaccttatctatttcgcgcctcaatagggctacaaaatcacttaactcatcaagtgccacttgctcttcattactcgtactactaacttttttggttgctggatttgttgttgtcgccgtgttgctggtaatactgctgtaacaaccacacaaagattcccgaatgacgcatcttgtaatggtggatccattttctttctaaagttcatggcatgggttacagtggatatagaaccgggcggagcagatttcactgctgacttccatatcaaagcggaaactacctcaacccttgtcggcctatggcatttgtatttatcatgcatcaaggattgcaatttttcacgtgcagatgtaatctttgccgcatcaaacacaaatcttttgctgacaagtttatctacgctggtactatcctgtgtaggataggaaacttgagatgccaattgttcactaggtggaaagagtgatgtcgaatcgaaaga

SEQ ID NO: 563 - DNA, 1545 bp, Chelidonium majus
cacaacttagaacgctaaccaagttgatcaagatggaccccaaaattaaagtagtactcatctcaaatgagaccatcaaaccttcatctccaactccccatcacctcagaaatttcaacttctcccttatcgatcagttctcttctccaatttatattcccattattcttttctacgaccaagtcatcgatagcaacattgacgacgaccaccgatcaaatcgccttaagagatcgttatcagaaacactaacccgattctaccccgtcgcaggtaggatcaatggaaacgtatccattgactgtaacgacgaaggtgtcgactattttgaaacaagaattcaaggtaagatgtctgattttatggtgagaccggaattatataatcacctcttaccatctcatatagtttccaacatatttgctacggatgcacaattagccgttcaagtcaacgtgtttgactgtggtggactggcaatttgtttttgtatgtcacacaagattgccgatgcatcaagcatgaccactttcatcaacgactgggctgccaccactcgtggttccatggccgaaagtgtgggtcccattttcgaatccgcctcgctcttcccagctagagacatacttaaaacatcaatagaacccgtaccagacacggctggagtagacgtcgtgaccaagaggtttgtatttgacgcgtccatgatagctgctctgcgtgccaagattcagggtactactgttacaagtgtcgggaagtacccgacacgtgttgaggccgtgtccggtttaatatgaagtcaaccatagaaatgagtaaagtaaaattggaatcgggttcttcaacaaaaccgttaaaagcgatggttgtccaccactcggtgaacttgagaaagagaatggacccaccattggctgacgtgtcatttggaaatatcatcactttaacaagcgcagttgcatcatcaactatgatcatgtcccaagaagtagagctggaggaattggtgggtaaactaagggcagccataagtaggatcaacatcagcgattacataaacaaaatgctaggttgtgatgatgatgatgaggagttcgtaagattgcttaaagtgagtaatcgcttcgcaaaagaagtaaataatgatgatcacgttgatggggaggacaacaccgacactgatgccgattccaatgcagatgatgatgatgtttactggatgagcagttggtgtagatttccagtttatgaaagtgattttgggtgggggaaaccacatttgtatgtacaaaacagtcatacaagaatgtggttattttgatggatacaagatgtggcggtggaatagaagcgtgggtgagtttggtggaggatgacatggccatattcgagcgtaaccccaatcttcttcaatttgtttccacaattaactaattagattggaaaaactagtttgtagatggggtgatttggttaaaaaagtgtaattgatttgtactagataactatctgtcatgtgtatagattattatgcaataaaag

SEQ ID NO: 564 - DNA, 1510 bp, Chelidonium majus
aggagttccaaggcatagtagagtaaagttcattaagcaaaatggtgctaaaggttgaaattatctcaaaagaaaccatcaaaccatcctctccaacacctattcaccttagaagcttcaaactttccttcttagatcagatcactcctcccattcctttcaatatccttttcttctaccctgcttccgatggttcattcgacaatgtcaaacgatctgatcggctaaagaaatctttatcggagacgttaacctatttctacccgttagcaggaacaatcggtgacaacataactgtccaatgtgatgacaatggtgttcagttcttggaaacccaagtcaattgtcaactctctaaagttcttaaacatcctgaagctcaagttatgaagcagttcttgccagaccctggtatgatgtgcaatgaattgggtaagggattgcaattagcaattcaagtcaatatgttcgactgcggcggaatggtgataggaatgactgtgttgcacaagattattgatgcaggatctttgagcacattcattaatgcttgggctcgaactgctcgtggaaccgacgagactttgggtccccgtttcgactccgcatctcttttccctcctaatgaagtacccgggactacattcctaccgatgaaaatgaaccccaattctgctgagaagattgttacaaagaaatttgtctttgatgcttcaaacatagctgctcttagacaaagcttctcattctgaacatgtgaagaatccaacccgggtagaatcggtgtcagcactcttatggaagtgtgcttggaacgccaaatcgaaatctagtgtggcgaatgtgattgtgaattttcgtagtagaatcgttccaccattgcctgaaaattcttttgggaatctaattgggatgtcaacgacaaagataacgaatcatgaagaagcagagttgcattacttggcaagaaatctgagagatgcgatacggaaaatcaacaatgattacatgaaagaattacaaaatgatggatcattaaggtcgacattagaagcacctcatgaagagttcaacaatgatgaggtagaggtctatacaatgactagttggtgtagatttcctttctatgaagtcgactttggatgggggaagcccatttggatatctactgttaatttgcttgtcaagaacggttttatgttaatggatacaagatgtggaagtggaattgaagcatgggtgaccttggatgaacagaaaatggctgaatttgaatctgatctcgatcgagcttcacaaattcatttctcacaaaaccaatagaccgatgcgtaatcgacttttcgcacaatgcattagattgtaatcggggtttttttagccgttatatgtgtatcaatctctttgtgaaaattaagacagaataagttcaagcctcaagtacattgatacgacgatatctaacgtacttgtagaatatttgctttacacactattgcctaatagccgc

SEQ ID NO: 565 - DNA, 1614 bp, Cissampelos mucronata
aatgcatttatatatatttttcttaccacacccatcccaagttgatgtgttgcatgaaaatcctaatgtatactatatatgtagaatgctctagtgtgataaaatacagaacatataaagaattttactccttatgcagtgagaatagtaacccttaatggatgaccaccattagagaagactcagaagagtagaaccttagttgatgatgaagggcactacaggtgctcagtcaagactcaagtattggaaacaaaggagaggaactcctcatctttctccaactcaaccaagtcttcctccaccatgttcaaccaagcttcaatcccatcaccaaacttactatctatcagtatcacaaggttctttccaggagtcttagttgtggaaacccaaatgggccttccccacccaaaatttgcgtcataaaaagggaacctacaccaactgttgaagttcattgccacaacctctccttttgagaactgcttctgtatttcttcaattgaattcatgaacccttcttccccacattgaagtttcctcacataatcaccatccactctcctcattgcatctctcaagtgcttcaccaacacatgacgatcacttcttgtgtcacttccaaactccacacattttgtaattgttggccttgatgcattcccaaatgcattgcttggcagtggtggcaccattctccccctcaagttcactgcggcactgctatagatgccctttcaggtcctgcctttgctctagtcgcggcaatggcgcgctcccaaatgaacgccgacaccgcttctactcgagttggatgctccacttcggtgcctcttaaagcagcaaccttctcgcccttgaatacaaatctcctggtcacaatgttgctaccttctccaactccaccgcggccactcggggttgctccatctgaatctttagcagggaagagagaaggcaagtcgaacgacggattaggcagagcatttttactagaaccattagctgcatcagcccaaaatcttatgaacgtcgccattgctgctccgtcggcaatcttgtgcgaaaagcagacgcctaatgccatcccgccgcaatcaaaatagttggcttgaactcctaggagtgccttggcaggcaattcttcattagtcacataaggtgcacaaggaagaagtttatcaaggtcatcaatgttaggccgtttgagaaactcagcgagtcgaacacccgccttggcttccgaaaactcgactccctgaccatcgcaatcgactgcggcgccatccctgattctccctgccactgggtagaaatgagttaaggtttctgaaagagatgtcttcagctgatcagaccttttggagatgtgatcttcatggtttccaacaccacaacctgatgggtagaagaggatgatagtaacatagtttgaagtggctagatgatccaacaaggacagtttgagagagttttcgcgatgaggatcgactggagtcgatggtgagatgttctctctagagattatttggacctccatgtatgggtaaaaagaggctcttctagattgctaattttgtcctctgatgaagactaggccagcagagtctt

SEQ ID NO: 566 - DNA, 1732 bp, Cocculus trilobus
taggataacataaaaacagtagacctgatttagcaatctcatgattgaaaactgctctctagcccttcctcctctttccctatcacagtacccaaagtgcacccttttgagtcctaatgattcttcctttttatttgcaacaaataactaatctaggacaacatgattctcagataaagaaattccagagcaacttgtctaaatataccaacatgatcatcacaatttcatagatataacttctttgctttctaaatttccatgagttcttggaaaatcttcatggatgaagcagggagaccaagaagaacatttatgcttttcctctctttcccatgagacaagaacaaaatgacttccttctcaggcagagtcactggccctgataaaataggttctccccacccgaaatcggtaatatggaatgaaagcctagaccatgtggttattagaagagttgcagcaagtgaaggcctggctcttgttacttcaaagtaatctatagctgatctcatgtaactatcagtgaccatcttcaccgccctctgaaccaatcccactgtaaatgacaatggattctccaacacctcgcccgcattgcacaaagagttcgttaacacgattccgttcccagagtatccctttggcaatgggggctcgaacctaggcctcccatccacagcaaagaggagctttatctgttgatcaggtttcatcttcaaggcctcacatctagccttccacacaaatgcagagagagcctcaaaggttgtgcattttgcgatgacattatcttccatagcttttttcttgagttgttctarcttctgagtgtcaaagcagaaggacctgtagagcatttcctcttcgtagagactggaagtkttcgatatrtcctcgatctcygcgaattcttggtgggtaaactctattttaggagggattcgagccttgagtatgcttctgtctaggaacggcggaacagttagcggttcacctcgggcggtctctccccatgagttcacgaactccatggctcctagaccatcaaacatgcaatgattcatgcatagcccaagaacgaatcctccacacttgaattttgtaatctgagccacgagagggggcatttcaagtatgttctttgcaccaggaatgtcataaaccaactttcctagtgtcactggatcaggttttgtgatgtctcctatgtcttccatcttacaatctgcctcagcctcaacaaaaacacctccttcgcctgtgcaatggacgatcaacttcccttccgaactgatcgtaagacgcccggccatgggataataatgaacaagaacctttgccaaggcatcctttaggacctcccctgctctctcattacccttctcttccgacttgaagcaataaacagttcgaatgatcaccgcgatgttttggtcsaggttagagaggaagtagagacccttcggcgtgtcctcagcaggaggaacaagagttggttctcctaccttcacactaagctcaaacacattcccattagaagatttctgatccattgcaacagactctccaagctcaacaacctgaaaccaaaaagaagaagataaatttttttttattagagtactcataaggagagacccatatcatatgatggaacaaagtgatcatagttgatgcatttaaatgtgatattccttagtttgttagaaaacagaccatgtgtaagaac

SEQ ID NO: 567 - DNA, 1640 bp, Eschscholzia californica
ccattttaggcccaactatccaaatttcgatcacagcatcacattggcgttttaacaatagtacctaatctcatgtttacttgttcttgtaaacagaaaactgtcaattacgacaacccatatcaataaaacgttgcaatatgactaagtgagacgaaaaatcgttaaagctagtggatataaaacatttgatgaataacataaagtatgataacattctctaaaaaaatgaaattacatatattaatttgtttataacttacgcgtgttcacttagttacataggcaaattcgaggaggttctcattacactcgaaagcggtcatatctttttcttccaattttacccatgcttcaattccttcaccatctctagtgtccatcaaaacaatcccattcttggctagtgcttgacctacactataagttacccaaactggttttccccatccaaaatcactctcatagaatggaaatctacaccaactactcatcatatacatatttttaccatcttcattcatcaaacctgcctccttagttacccattttatgaactcttcaccactatcacctcgaagttttctcacataatcttcgtcgatcttatgtattgatacccggagatgtcctaccaattcatctaacgaataagaattcttcggtattaaggttgttgttgccaaggtcactatattcccgaatgactcttgagtcaatggtgggtccattttccttcttaaattcacagcttggtttaggattgacatagactctgcctcagggttcatgagtgatttccaaattagagctgacacagcctctacccgtgtcggatacttcccattagaagttttggctatcctggcgcgtaaacttgctatattggctgcatcaaatacaaatctttttgctacgagtttgttttcaattgttccatctttgagttcgacaggcgtgtcaggtacaggaaacgatacttgtctaactgaaaagagagaatgggcgtcaaaattaggaatgacaaattcggtttccccacgagccgttgctgcccaacagttgatgaaggttgcaatagatgatgcatcaaagagcttatgcgacatacacatcgatattgctattcctccacagtcaaacatgttgacttgaatgatcaatggtgttcgactggccatatctaaagtgggtatgagctgattaagtagatctgcgcttctaaattctgtgatgttaccattgacttttgcttcgaagtagtcaacacctagatcgttgcactcaacgaagatgttatctttgatcctaccggccaatgggtagtaacgggttaagacgttagacaaagattttttaagtaaatgatgatagttagattcggattcaaatgaatttgtgtgattagattcgaagaaaagaacgacaggaacgtaaactggataaataacctgatcaagaagagagagtttgtatggagaaaggtgagaaggagttgaagaagagggtttgattatctccttagaaatgactcttaccaatttatccatcattactgccatgaatgaatcttttgaacaatctgtgaggactttatatttttttttctctctctctatatttcttcatcttatagatgt

SEQ ID NO: 568 - DNA, 1723 bp, Glaucium flavum
cctccctttggtcggccgataaaaggcctccctttggtgggccaataagtgtcctacgataaattcaatagtacccaatgtattgatatttttcaaacaattacttagcagatcgtggaagcaaattccaggagttgggcgtcacgctcgaatacggccatatcatcctccactaaacttacccacgcttctattccgtcaccacaactcgtatcaatcataataactacatttttataggactgatatgaacttaccataactggtttcccccacccaaaatcactttcatacagtggaaatctacaccaactacccatccagtaaacctcatgatcgtcatcgctgtcgtcgttgtggtcagtgacctcgtctccattatttacttttttcgcgaaacgaccactctcgttgaccaatctcaagaactcctcatcatcatcaccaccactttgcaatttcttgatgtaatccccgttgatcttacttatggctgccctaagttgtctcactaattcctccacgtctacttgtttagccatcaacatcgttggtgatgctactgcggttgccaaagtgatcatatttccaaatgaccggtcagccaacaatgggtccatcctctttctcaagctcaccgtgtggtgcaccaccatacactttaccggtttccttaaggaactcgattcgatttttaattttttcactttactcatttccatgaatgatttccatatcaaagcggatacggcctcaacgcgtgacgggaagtatccgactcgtggagtggaggtgttctggattttggcgcgtagagcggctatcatggatgcgtcaaacacgaacctctttgtcacgaccgctttattaacgtctccgattgtacgattgtctatcccatgcgtgtccggtccgggtactgctaatgtgttaagtatttctctcggtgggaagagaaaggccgacttgaaagtgggcgacagagtttttgtggatccacgattggtggcggcccagtcgttgatgaaagtggtcatagaggatgcatcggctatcttgtgtgacatgcaaaaactaattgctgttccaccacaggcaaacacgttgacttgaacggctaattgtgcatctttagccaatatgttggaagctatatgacatggtaagaggtgatggtgttcccgcggtcttgtcataaaggcagacatcttaccgtggattcttgtttcataatagtcgatgccttcatcgttgcagtcaacggatgagctatctttgatccttccagcgacagggtaaaattgggttagggtttctgaaagcgatctcttaagccgattagatcggtggtcaatatcatcgacttggttcccttcagtaggacagtcaccaaggggtgcagcagcagcatagaaaagaatgatgggaacgtaatgtggactagagaactgatctaggggtgtaaatgggcagggccgtaacggatagggcagggcagcgtatgtcatgaaatatgatatccattaaggcccttagggcagggcaaggtagtcctctttacattttctcttgcccactactctcccaatcctggtaccctagtagagcaggacgggcaaagtcgggcagggtacagggtacttgaaatgtaacaatacagttttaagcataaaaaaattgattttacacttgaatttagaaatcagatatttgttttatacaa

SEQ ID NO: 569 - DNA, 1741 bp, Glaucium flavum
gagacaaaatctaattactagattcgaactgatacgtttagtagatcaatactcttggcatgcaaaacataccaagatggagcctaaatatacacatttattgcttcattacaaacgaaatatgtatactgaactgtaatacaaaatataaatatcaacaatagacattatcacacaaccaaatacacaaaattataggaacataacatgattgaatttgaaacgaagaaactttgaagcacccggcaggagatcgaaatatagtaacattttccttttttcacctcagactgatcgagctgaataagaagttattaagtcgccaggactaggaatctaagaagcaaatttaagaaattccttgtcacattcaaattcatccatgtcttctttagtcatgttcacccatgcttctattccgtctcctgatctcgtgtccatgaacacaacaacatttttgaaaggaagcggagcagtcgctgcccaggttggctttccccatccgaaatctgcttcatatatgccgaacctgcaccagctactaaagtgtagcatcacattcgacgtctgattatttgaagcagcgttttccatttgtttcttgtaaaaattgaagtatgcatctgtatgttgtagtttcctaacatgatcaccatcgattctctttatggcctctccaattttcacaatcaaggttggatacggatgatctcccttgccctcagcatcaacgaggagcgcaaaagtaggactatacatattgccaaaagcgtttgttggcaattgtggaaccatccttttcctcaaattcactgcttgtgttaccctatacacccgtgccgaagcttcttcttttgcttgattcagtttcatgaaacgcttccaaacgaaggccgataaagcttcaacacgggttgggcactctcgatgtccgtcgccgtttatgttagtagcattggtttctactacactttgtttcttgagttcagttatcttggatgcttcaaaaacaaacctctttgtcacaatttgttgtttgtttttcttgatacttcctagggtattataacccatcagatctaccttgggaaacaaagttggcaactcaaaacaaggatccataatttgatcagtagcaccacgagcacaagcggcccagtcgttgataaacgtagacagtgaagaagcatcagctagcgtgtgtgagatgcatataccgatcactattccaccacaatcctcaaagacgttcacttgcacggccaagagcacttttgacgtgacgggtgtggactgattggtgctgtacgaatcacatggcaagaattgttgaagtacatggacctcagggtgttggataatttgagagagttcaccattagttactttggtttccaaataatcaacaccctcatcgttacaatcgacagagccctcatcttggatccttccagccaatggatagaatctggttaagctcgcagataaagatttcttaattatgtcaggaaaatgagagttattgtcgttgtcgtattcatcacttttgtagaaaagaacaagtggaacataaattggaggagcaagctgatcaagaaaagataggttgaaggttctaaggtgatgaggagttggagaggatggttttatcatctccctcgacactacttcaaccttcattttcatggtgttaaaatcttggcttagttagctaagagttgaagaaaactttattttcttt

SEQ ID NO: 570 - DNA, 1738 bp, Hydrastis canadensis
gcaacattggaataaatctcttgattcactcactttaattggatcaaacacaacaatttcatttattaagagtaacatttcaaaagattctgggcaaaatgactctaaatgttgaagttatctcaagagaaacaatcaaaccatcctctccaacaccccatcaccttaaaaacttcaaactctcacatttagatcaatacactcctccaattggtgtccctataattctcttttattcggcaaaccatttcgaaaaaacaaaaatgtctgatcggttaaagaaaacgttatcgaagaccttaactgatttctacccattaggaggaaagatcaaagataacaactcaattgactgcgacgacagtggtgttgaatacttggaaactcaagttaaagctcaactctaccaatttctcaactgtcctgaagctgatgaattgaatcaattaattccattgaatctaaactgcactggaatgagctcagaaatacaattagcaattcaagtgaacgtattcgaatgtggtggaattgcgatcgcagcatgtatatcacacaaagttgctgatgcatcaagcttgtgcacatttttaagtaattgggctgccaatgctcgcggggctaatcatgttgtgtttccacagtttgattcagctccactcttccctcctagagaagtatcttcacttcaactaagcaccgaaggcccaacgcacaacgttgtcaccaaaaggtttatcttcgattcatccaatatagctgctctcaaagccaagtctgccaattatgtggagaatccgacaagggtggaagctgtggcgaccttcctatggaggtgtttcatgaatgtagctagtttgaaaccaggatctataaaatcatttatggtgaacattgcggtgaatttgcgtagtagaatggttccaccattgccagatcattcttttggtaatctcattatggctgcaatgccttcctccacggcggatagtaaagcagaattgcattgtttggtggggcagttaagggaagcgataaggagatacgacggtgattatatgaaaaatttacaagatggtgatggtgtatcaatgttttatgattctatgagacaggcaattgaactatttgccaaaggagaaatggggttctacacaattactagttggtgtaggttccctttctatgaaattgattttgggtgggggaagcccatatgggcaagttctcttaacatggttcataaaaatgtggttatcttaatggatacaaaatatggtgatggaatagaagcattggtgactttggatgaagaagacatggcaagatttgaatgtgaggaagagctccttgcttttactagccccaagaatatagcttatgtgcaagagctccatgattttactaaccccattaagatggcttatgaacaagaggtccttgcttctactagcccaaatgggatggcttatgagaagagatccttgatttcactaggctaaatgggatggcttatgagttcaagtcaaccatgattcctagatcatataatcaccgtctttaattatgttctcctttcttttatgcttcttagttgttaaaatgttgctgttttttgtgtgtgtgtttgtgtttgtgtgcgcgctattatgctatgttcaaagccagagtagctcgtacctgatctttgatctattttgtgatcaagctattaaaatgccattcctagttattttgg

SEQ ID NO: 571 - DNA, 1722 bp, Jeffersonia diphylla
ccaatcaaacaacagaggactaggattccaccaggaattcatcaggaaaaatcccaaatgaaaaaatagcaaggattccatttcttcggagcaattttccctgtgtcctgcaatcaaactagccctaattgaagttggtgattacatcaaaaagctttcagactagtactaaagtggcgaaagcaaacatcctgtgtgtggcttaactcaactaacagtccacacaatgagttgaggagagaaatgagaggagttgttcatcttgttcaaattcagccatatcttcttccgccatcctcaccaacgcctcaatgccatctccagatcttgtatccatcaaggcaacaacatttttgaaatcattccttgcagaaataccagtagcccatacaggctttccccaaccaaagttagccttgtacaaaggaaacctacaccaactagtgaacattatcagccctgttttacctgtgctaattcctttgctatattcatcctctaaatgttgaatgtattcaccatcacgtcgtatttttgtcacaaactcgctgtccatttttcttatagcatctctaagctcgcccaccagcacatacaactcattttcgcttgctaactctcgacttgttgtgaaggttggagcacaaagatttcccaaggcgttctccaatcctttaccatccattctctttctcaagtctactatatgcattgccgcacattcctttaaaaacccattttttttcctagtcaattccatgaaacacctccataataaggcagacacaagttcaacgcgcgttggggatggaacacatgagctattattatttatcacctcggctctaagggatgcaatgttggatgaatcaaatacaaaccttttggtgacaaggttcggtatagttgattgaaagggagcgctgttaaggtccaaaccactaggaggataaagagacgataattgttgagagatggggtggattagttgattagaatcggaagtcttagcagcccaagaatttataaatgtgatcattgagtaagcatctgaaattttatgtgacaagcaaacactaataactattcccccacactcaaataaattgacctggattgctaggagtacttttaaagataactggggttcttgatcatcacctggcgaaagcagttcaaggacttgatccacattgcgatgtttaatgacatcttcgagttgagctttcactcgagcttctacatagtcaacaccttcatcgttgcattcaattgcaatatatccgttcattctcccagctataggatagaagctacttaaggtttccgacagagatgtcttcaagcggcgggatatgtccgaaaactctatcttcttcgtatccttattatcatagaatagaaggatagaaaccctgtcaaaaccggctagcagatcaaaaagacctaatttgaaggttctaaggtgaggaggagttggagtagatggtttgatggactctctggacattatttcaacttgtattgacatctttaggtgagtgtgaattggtattcactgatgttgctctctatataattgagctcactatatgttgtgctgatcaaatttcatttggattcaacttgtattgcaatgccttgcattattgacaaataatggacaccctggaaagygayarsaracaagtaatggatattttgtttgttgtcacttgcgag

SEQ ID NO: 572 - DNA, 1563 bp, Mahonia aquifolium
ctcattcttccaagtcttttcgcttgctagaatccgcggtgatcattcgagaagagaagctttttgtatctgtatatacagggtaaagatgatcgtaaacatcaaggaaaccacgatggtgcgcccatcagagccgacgccaaaacggagcctatggaattctaatgtggacttggtggtgcctagaatgcacaccccaagtgtttacttttataggccaaatggttcatcaaatttctttgatgccaatgtgctcaaggaggctttgagtaaggctttggtaccattctaccctatgggtgctagacttaaaagggatgaagatggcaggattgaaattgattgtgatggacaaggagtgttgtttgtggaggctgagaccgtgtcggttatcgatgattttggggactttgcacctaccttggagctccggcaactcattcccactgtcgactattctggggatatttcttcgtatcctcttcttgtgctgcagataactcatttcaagtgtggaggggtctcacttggagtagggatgcaacaccacgtggcagatggagcatctgggctccacttcatcaacacatggtccgacatggcacgtggacttgacttgaccatcccacccttcattgaccggaccctcttacgagcacgtgacccgccgcgacccgctttcgaacaggtggagtacttacccccacccgcgatgaagaccccgctaagtacacccacagattccacctcagttgccatcttcaaaatcactagggagcaactcaacatattgaaagccaaatctaaggagggtggcaataccatcaactacagttcctacgaaatgctcgcgggtcatgtgtggcgatccgcgtgcaaggcacgagggttaccgtatgatcaagagacgaaaatgtacattgctaccgatggacgatctagattgcgcccagcacttccaccgggctacttcggcaatgttatattcaccaccacccccattgcggtatccggggacttgagtgctaagcctctaacctatgccgcgagtgtcattcatgaggcattagggcgaatggacgatgagtacatgcgctcggctctwgattatcttgaactacagcctgatctagcggcccgttcgtggggcacactcatttagatgtcccaacatcgggatcacgagttggtcgaggcttccgattcatgatgcggactttgggtggggccggccgatcttcatgggccccggtgggattgcttatgaagggctcgcatttttgctgccgagcccgatcaatgatgggagcttgtcattggcgatttccttgcaatcggagcacatgaaagtattcgaaaaaattctttacgaattttaatcaacaaagagtggtgattcaatgaggttaatctcacagcgctcacttaataagagtgagactctcatccattggatcgaatggatagatctaattcttttattccatttaattaaaaagaatggggggaagttagaagtggaaatatcacaacctgaacattgtgtttctttagccaattgtc

SEQ ID NO: 573 - DNA, 1639 bp, Menispermum canadense
acacaaatgaagaagatgatgaagtacatgaaggtccaagtcgtttctaaagagaccatcaagccctcctctccaaccccacctcacctcagaacctacaacttctccctcatagatcaacacattcctcaacttctttatatacctttcatcctcttctactctcccaatatacatcacaaggaccacgatgatgatcatcatcgtcaactcatcaatattcaaacacaaagtcttgatcggctcaagacttccttgtcagaaacattaaccctgtattacccattagcagggaggataaaaaacgacagcataatctgctgcgaagatgaaggcgttgaattcgttcacaccaaagtaattgattctcccctcttagaacttgtcaacaaagctgaaccagaaaatctggctcaactcctcccgcgtcacgatcatcaacgcaacgaaaagccaccactactgagtattcagttcaatgcgttcgagtgcggtgggatggccatcggcctttggttttcacacaaagttgcagactcgtctagtctctgcactttcctccacaactgggcctctattgctcgtgggtcattgtctagtactgaaatcttgtgtcccaggttcgactgcgcgactcacttccctccaaaacaactgatgtcgccactgcaacatgtcaaaacaaaaggagaagtggtttcaaggaggtacatctttgatgcctccatgatagctgctcttaaagctaaagccagtactactatcaaccgcaactcatcatcgtcaatatcgccttcaagggtcttggcggtgatagcgttcttgtggaggactgtgatcgccatggatagagagaaacaattagggtctattaggcctttaaacatgggcattgcagtgagcttacgttctaagatggagctgacattgccagagctttcgtttggaaacctcgttgccatcgggatgacatccgcatttcatgagcaggaagtggtagaacgaattggggatttgttcggcaaattcaatagagattacgtgaaaaagctacagtccggtgaggagtacttgaagttgatggagtctttgggagaattggaagagcagatctgtagaggtgaagcggagaggtatggagtgactagttggtgcaggttcccattctatgaagttgattttggttggggaaagccagtgtgggctaacgttgctgcttttgaggacaataacttttttgtgttgatggatacgaggtttggtgagggaattgaagtttgggtgagcttgggtgaagatgacatggctagattccaacgacagttggatcgtgagcttctagtacttttcaactcgttcagctcggttggatcagcttgatgaaatattaacgctaaaataacgtacctttcttgcacaagtgttggaattcattagatatgcatggagatgtagtatgtatctccatgtacatatgcgcatttcaatatgtagacaattgtgtaagaaatatgcacgtgttaagaaatatctatataattgtgttattgtagcattatcgtcgctacatcttactcaagtgctcaagtgcttaacaagatgtagattaagttgacgaccctttgtataattactcatt

SEQ ID NO: 574 - DNA, 1495 bp, Nandina domestica
ccgatctgcagtgatgaaggttgagaaaatttcgagagatttcatcaaaccatcaactccaacccccgatcaccttcgaaccttcaggctgtctcttcttgatcagctcgctcatccagtttttgtccccatcattctcttctactctagtcccacaactactcttgatgatgatcatcagctaggtgtatctaatcagctcaagaagtctctatcggagaccttgaccctcttctacccgttagcaggaaggatcaaagataagctcttggtggattgtagcgatgaaggtattgagtatttcgaatctcgagtcaacggtaaaatttctgattttatgaaacgagatgaactgcatcatctcctaccttatgatttccaatctaccttgaatgtaattgttggtaacgattcacatttgatcgttcaagtcaacttgtttgactgtggtggaatagcaatttctgtttccatttcacataagctagccgacgcagcaacattgaccacatttatcaatacttgggcttccatcactcgtcaggcaatccccgaatcaattgtcagtccgacttttgattcagctattctgtatccacccagagaaggaatgtcctcacccttttctggtgcaattaataagcatttgaccagtaaggtacaagctggacaagccgaaaagagagtgacaaggaggtttgtgtttgatggcaccaaaatagcaacccttcgagcaagatatggtaattccaatgatgagaagaagaagaagaagaatttgcccacacgagtggaggctgtgactgcacttatttggaaaactgccatggcagcaacttcttccccaaaaccatcgattgcaaacattattgtggacatgaggagaaggctggacccaccattgccagagcaatcatttgggaatctcgcgacaacagttgcaagagtggcaccatccataacaaagagtactggagagatggatctgctgggtccaatgagggaatcgatacgtaaaatcaacagcgattccttgaaggtgcttcaaggtgatggagggttcataaagtttcaagagtttatgaagatggcattggaaacaaatgggaatgaattggagctatataggtttactagctggtgtagatttccggtgtatgaagcagatttcggttgggggaagccgaattgggtagctgttgctagtctgccattcaagaacacctctcttttgatggatgacagaacaggagatggaattgaagcctggatttgcttgttggaggaagacatggctagattcgaacgcgatcaggaactccttgatttcgttactttgttggactgagcagctcatgaactcctctttgttttcccgcaataaaatcaaatgtcatgtcactcaattcttacgtatgtatgcttgtatgaactgatattgactcgtactaattactttcctgttgttcattggatatggatctagctggtttct

SEQ ID NO: 575 - DNA, 1432 bp, Nigella sativa
tctagctaccaaggaatggaattgtaagtgtgtatattgatgcaaaatgactccgaaagtttcagttctgtcaagggaaactatcaagccatccctaccaacgcctcctcatctcagaaccttcagactctcccttttagatcagtacagttttccagttcgcgtccccgttattcttttctattttaacgatggagagaatgatcacactaaaatatccaagttgaagacatcgctttcggatatcttaacccatttctacccgttagctggaaggattgtgggtgatcgtttgattaactgtgatgacagtggtgttcagtacttggaagctcaggctaatacccagcttgaaacgtttctcaaatatcccaaagcggatgaattaaatcaactgctaccactgaaactacaccacaatgatgagagctcagaaacacaactgcaaatacaagtgaatacatttgaatgtggtggaattgcaattgctgcatctatatcccacatggttgcagatacagcaactttgtgttcattcataaatacatgggctgccaaaagttgcgggtgcagcaaaactatgcccccctgttttgattctgtagcactcttccctcctaaagaaataccttcattccagcttcccatgggagatcaaactcaaagggtaatctccaagaggtttgtcttccattcagcaaaacttgcagctttaagagccaaatcagtgagtaagctggaggtggagaaccccacacgggtggaggtcgtgtcagcacttgtgtggaaatgtctcatgaatgctgccactcggcgacaggggatgtcgtttacagtgaacatggcagtgaatttgcggagtagaatggttccaccattgtctgacaattcgtttgggaatctcattataggtgctttgccttctgctgaaagaggcgaagcattacattgtttggttgggaaattcaggaaaatgattaaaagagattactcgaaattaccggagaataatggaatatcaatatttcatgatgggttaaggaagacaatggaggcggcagcgagagggaaaattggaatgtacacaataactagttggtgtagatttccgttctatgaagctgatttcggatgggggaagccgatatgggcaactactgtgaatgtggatcataagaacattgtgatgctaatggacaccaaagatggtgacggaatagaagcattggtaacactagatgaacgggatatggctttgttcgaatgtcagcaggagctactcgactttgccatcccaaattcaatggtttcttgatatctacatctcctgccagcatctaacaactcagttgccaaagctgagaggttatgggttcaaactcgcaactgcttatgattgataaatgagttgtatacgtaagttgaagagagg

SEQ ID NO: 576 - DNA, 1705 bp, Papaver bracteatum
cagaaggcatcatgttgggaaggtgggaacaaataagctggagtatcttgagcacttgttcatgtctcaccttagtgtgaatcaattgattaagaccttgaatattgatattgtacagttgggattatatggaagctttgtctagtgttgatgtcgaagtgatctccaaggaaacaattaaacccacaactccaaccccatatcaacttagaaacttcaatctgtcccttcttgatcaatattgtcctatagtttatgttccaatcattcttttctaccctgctgcagtcactaatagttctggtagtaagcaccacgatgatcttaacttgcttaagagttctctttctgaaacgctgggtcaattttatccactggccggtaggatgaaagacaacattgtagtcgactgtaacgatgaaggtatcgactttatcgaagtaaaaatcaagagtaaattgtgcgacttcatgatgaatccagatgtacgcttaagtctgcttctcccatctggagtcgtttccatgaacttcgttaaggaagcacaggtgattgttcaagtgaacatatttgattgcggtggagcagccatttgtttgtgtatatcacacaagattgcagatgcatgcaccatgagtacattcactcgttattgggcagccaccaccaacacagctcgtcttgggggagctatcggtcctccaaacacaaatccgttgtttcttccttctttcgactcggcatctcttttcccacctaacgaacaattggcatctcaatcagcgatgccatccgttacttatcctactgaggatagccgaagacatatagttgtcagcaaaagatttgtgttcgatgcggtaaagttaaaatctgtacgtgaaaagctacaagtattgatgcatgataaatacagatcccgtaagccaacaagggttgaggtggtttccgctctaatatggaaggcagccatgaaatccgctccgtctggtgcttcatcgacggtaaaccatgccgtgaactttagaaagaaaatggacccacctttacaagatgtgtcattcggaaatctttgtcaggtcgttgcagcattattaccagcaacaacgccggaaacaacagaaaattcagataacaagacagttaatagtacaagtaatgaagtgcaagtggcacttgatgagttaaatgatttcgtagctcaattgagaggcgaaatagataaggtaaagggcgacaaaagttgcatggagagaatgtttctaaatttcatgaatggttatgatgcctccgaaacgaaagacagtgatgttgaagatgaagtgatagctttttggatgactagctggtgcaactttggtttatatgatgctgatttcggttggggaaagccaatttgggtaactactgatccatttatcgagccgaacaagaacataatttacatgattgatacaaaatgtggtgaaggaatagaagtgtgggtaaactttcttgaggatgatatggctaagttcgagcatcacctaagcgagatcctcgaattgttttgattttgcatcatctactttgtgttccaaaatcatgtttggttttcgttattttctttaataaagagacttattgcaattatgatgactatatgcacatcctcatttttacactttgaatccttgctaaagagaagtgttcctttctaaacgaa

SEQ ID NO: 577 - DNA, 1751 bp, Papaver bracteatum
aaaagaatctaccttgaatattgatattgtacagttgggattatatggaagctttgtctagtgttgatgtcgaagtgatctccaaggaaacaattaaacccacaactccaaccccatatcaacttagaaacttcaatctgtcccttcttgatcaatattgtcctatagtttatgttccaatcattcttttctaccctgctgcagtcactaatagttctggtagtaagcaccacgatgatcttaacttgcttaagagttctctttctgaaacgctgggtcaattttatccactggccggtaggatgaaagacaacattgtagtcgactgtaacgatgaaggtatcgactttatcgaagtaaaaatcaagagtaaattgtgcgacttcatgatgaatccagatgtacgcttaagtctgcttctcccatctggagtcgtttccatgaacttcgttaaggaagcacaggtgatcgttcaagtgaacatatttgactgcggtggaacagccattagtgtgagtatatcacacaagattgcagatgcagccacaatgagtacattcactcgttattgggcagccaccaccaacacagctcgtcttgggggagctatcggtcctccaaacacaaatccgttgtttcttccttctttcgactcggcatctcttttcccacctaacgaacaattggcatctcaatcagcgatgccatccgttacttatcctactgaggatagccgaagacatatagttgtcagcaaaagatttgtgttcgatgcggtaaagttaaaatctgtacgtgaaaagctacaagtattgatgcatgataaatacagatcccgtaagccaacaagggttgaggtggtttccgctctaatatggaaggcagccatgaaatccgctccgtctggtgcttcatcgacggtaaaccatgccgtgaactttagaaagaaaatggacccacctttacaagatgtgtcattcggaaatctttgtcaggtcgttgcagcattattaccagcaacaacgccgggtgcttcaccaacggtaaatcatgccgtgaacctaagaaagaaaatggacccaccattacaagatgagtcattcggaaatctttgtaaggccgttacagcaatattaccagcaacaacaaccacgacaacaacaaaaaatgaagacaacaaaacaatcaatagtacaagtaatgaagtgcaagtggcggtacttcatgaattaaatgattttatagctcaactgagaagcgaaatagataaggtaaagggcgacaaagattgcatggagaaaatcattcaaaatttcatgaatggttatgagtacgccaccacaaagaaaaaaaatgatgttgaagatgaagtgataaccttgtggatgactagctggtgcaacatgggattatacgagactgatttcggttggggaaagccaatttgggtaacgaccgatccaaatatcaagccgaacaaaaacataatttacatgaatgatacaaaatgtggtgaaggaatagaagtgtgggcaaactttcttgaggatgatatggctaagttcgagcatcacctaagcgagatcctcgaattgttttgattttgcatcatctactttgtgttccaaaatcatgtttggttttcgttattttctttagtaaagagacttattgcaattatgctgactatatgcacatcctcatttttacactttgatcactggggagtaaatttttgatggggccgtttt

SEQ ID NO: 578 - DNA, 1710 bp, Papaver bracteatum
cagaaggcatcatgttgggaaggtgggaacaaataagctggagtatcttgagcacttgttcatgtctcaccttagtgtgaatcaattgattaagaccttgaatattgatattgtacagttgggattatatggaagctttgtctagtgttgatgtcgaagtgatctccaaggaaacaattaaacccacaactccaaccccatatcaacttagaaacttcaatctgtcccttcttgatcaatattgtcctatagtttatgttccaatcattcttttctaccctgctgcagtcactaatagttctggtagtaagcaccacgatgatcttaacttgcttaagagttctctttctgaaacgctgggtcaattttatccactggccggtaggatgaaagacaacattgtagtcgactgtaacgatgaaggtatcgactttatcgaagtaaaaatcaagagtaaattgtgcgacttcatgatgaatccagatgtacgcttaagtctgcttctcccatctggagtcgtttccatgaacttcgttaaggaagcacaggtgattgttcaagtgaacatatttgattgcggtggagcagccatttgtttgtgtatatcacacaagattgcagatgcatgcaccatgagtacattcactcgttattgggcagccaccaccaacacagctcgtcttgggggagctatcggtcctccaaacacaaatccgttgtttcttccttctttcgactcggcatctcttttcccacctaacgaacaattggcatctcaatcagcgatgccatccgttacttatcctactgaggatagccgaagacatatagttgtcagcaaaagatttgtgttcgatgcggtaaagttaaaatctgtacgtgatttgcttccttctttcgacgcggcaactcttttcccgccgagtgaacaactggtatgtccatcagaagtgccacccacacccgtttcccatcataatgacgatagcggaggagaaaaaagtgtcagcaaaagatttgtgttggatgcggtaaagataaactctgtgcgtgaaaagttacaaggattgatgcatgataactacaaatgcaccagcaggccaacaagggttgatgtggttacggctttggtatggaaggcagccatgaaatccgctcctagggatggttttttaccaatggtaaatcatgtgatgagcttcagaaagaaaatggatccaccattacctgatgcctcatttgggaatctctgtgcggtagtttcgacggcggtatcaccgggagcaacggcgacaagtacgaatgatgaggtactggaggaacagttagctgaattagtagctcagttgaggggagaaaaatacaaggtaaagggtgataaaggttgcattgagaaaatctttctaagttttgttggtggtgacaatgccttgtggatggctagctggtccaagtttgggttttatgatgctgattttggctggggaaagccggtttgggtaactactgatctatcagttgtcgagccgaaccagaacctaatttgcatgattgatacaaaatgtggtgaagggatagaagtttcagcaaaatttctggagaatgatatggccaagttcgaatttcacctaagcgagatcctcaaattgttttgatttttgcatcatctatttgtatttccaaaatggactataaaagggactgttagtc

SEQ ID NO: 579 - DNA, 1727 bp, Papaver bracteatum
gttcttcacttgttaatgctataagttaaatgaatacaagtgagttcatcttaccaaagacatcggaattcgttcttgatcaacatcatccatctttctgaaccagtttgtgatcttaaagcagccaaccatgtctaatattattgttgaggtgatctccaaagaaaccattaaaccttcaactccaactccgcatcagtttaaaaaccatagtctctcactcatcgatcaatacattgtccccagtttcgttccactcattttcttcttcccagcagtaccaggtctttacgaccacactgctggcaataagcaacatggtgataatattttgcttcttaagaggtctctttcagaaacattatctcacttttatccgctggcaggtagggtgaaggataatatcgttgttgactgtaacgaccaagggatcgaatttatcgaagccaaagtcagtggtagtatgtctgaatttttgaagaaacctgatgaccatctaagtgggcttcttccctctaaagttgtttgcatgaactatgttacaaatacacaagtgtttgttcaagtgaactcgttcgagtgccattcaacagccatatgtttgtgtgtatcgcacaaggttgccgatgtagctaccatcactacattcattcgctgttgggcacagactaatatctcagttagcagaaccacgtccataggctcaaagttgcatcctacttttgattcggcttctctcttcccacctattaaacaactagtatcgccaacgatggtaacacctacagaactggattcaactcccttggaagaaagtaaatcaatcagtaagatcatcagcaagaggtttgtgttcgacgctaaaatgataaattctgtacgtgaaaaaatatcagcaacaatggtggataaatacaaaagtcgtaggttgtcaagggttgagatagtctccgcattgatatggaagtcattcgttaaattggcaacccctggttcttcatcagtaattgtaagacatgccgtgaaccttagaaggagaatcgacccaccattaccagatgtgtcatttggaaatattttagagttcaccaaactagtagtaggatcagcatcaacaacaacccaagggaccagtaagctgcatgaagacttaaatgaatttgtatgtcaactgagggaatcaataagtaaaatgaacaagggtgatcatgatttcgacatggaaaacactgaaaatgaagggagaaatttgtggatgagtagttggggtagttacggatcgtatgatattgattttggttggggaaaaccaatttgggtaactactgttggacctatgtttgcattctcagatgttttttatatgaacgacacccgttgcggtcaaggaatagaagtgtggggaaatttggttgaagaagacatggataatttccaaaggaacttgtccaagctcctagaaaggatttgaatccatttcattagtgtcgcttattaaggaagtatcccttgcgtgatttttctgttatttctggtgtaacaattatcctgtgacaagttccggtagctaatagatgtccaaatagtttttctttatgttcttgataatctgttaactctgcctagtgtaagaggaggcatcttgtattgttcttctcaggtaatgaaaacatttcttcagtgtatgtctctgctatggtacagagcagaaacaaagtttgatttta

SEQ ID NO: 580 - DNA, 1348 bp, Papaver bracteatum
acaacacttgttttatttcagtctccaaagaggtttgacacagcatatcaaatcaggcaatgttcttgtaaacaacaatcaggaagatatggcaacaatgtctagtgctgctgttgaagtgatctccaaggaaatcattaagccggcaactccacccccatatcaacttacaaacttcaacatctcacttttcgatcagtatatgcctccaagttatactccggtcattctattttaccctgcagccgtcgctgatagtaccggcggtagtaagctccatgatgatcttggcggcttgctcaagaggtctctttctcaaacgctggttcacttttacccaatggctggcaggttgaaagataacatggttgtcgactgcaacgaccaaggggtcgacttttaccaagtgaaaatcaaagctaaaatgtgtgacttcatgatgaaaccagatgagtttcccttaagtctgcttcttccggccgacgtcgtttccgtgaattttgttaaggaggcacaggtgattgttcaggtgaatatgttcgattgtggtggaactgccatttcgttgtgtatatcacacaagattgcagatgcatgcacaatgagtacattcactcgtaattgggcagccaccaccaacacagctcgtcttgggggagctatcggtcctccaaacacaaatccgttgtttcttccttctttcgactcggcatctcttttcccacctaacgaacaattggcatctcaatcagcgatgccatccgttacttatcctactgaggatagccgaagacatatagttgtcagcaaaagatttgtgttcgatgcggtaaagttaaaatctgtacgtgaaaagctacaagtattgatgcatgataaatacagatcccgtaagccaacaagggttgaggtggtttccgctctaatatggaaggcagccatgaaatccgctccgtctggtgcttcatcgacggtaaaccatgccgtgaactttagaaagaaaatggacccacctttacaagatgtgtcattcggaaatctttgtcaggtcgttgcagcattattaccagcaacaacgccggaaacaacagtaaattcagataacaagacagttaatagtacaagtaatgaagtgcaagtggcacttgatgagttaaatgatttcgtagctcaattgagaggcgaaatagataaggtaaagggcgacaaaggttgcatggagagaatgtttctaaatttcatgaatggttacgtaacgaaagacagtgatgttgaagatgaagtgatagctttttggatgactagctggtgcaactttggtttatatgatgctgatttcggttgggga

SEQ ID NO: 581 - DNA, 1570 bp, Artificial Sequence
  PsoOAT1 A new nucleotide sequence entered manually
cgcatataatccaatttgcattgtttatcgaccttgaggaacaattaggggatatggcaacaatgtctagtgctgctgtagaagtgatctcgaaagaaacgattaaaccaagaaatccaacaccatatcaacttagaaactacaatatgtcacttctcgaccaatattcttctctagtttatgttccgatcattcttttctaccctgctgcctccgacgctaatagtaccggaagtaagcaccatgatgatcttcacttgcttaagaggtctctttctgaaacgctagttcacttttatccaatggctggtaggatgaaagacaacatgactgttgactgtaacgacgaaggtattgactttttcgaagtaagaatcaaaggtagaatgtgtgacttcatgatgaaatcagatgcacacttaagtctgcttcttccgtctgaagtcgcttccacgaacttcgtgaaggaagcacaggtgattgttcaagtgaacatgtttgattgcggtggaactgccatttgtttctgtatatcaaacaagattgcagatgcatgcaccatgattaccttcattcgtagtttggcaggcaccaccaacatagctcgtcgtgggagctctattgctgcaccaaccacaaatcagaatttggttccttctttcgattcgacatcactctttccacctagtgaacaattggcatctcaagtttcctatcctacacaggatagtacgcgtagataaacttgtcagcaaaagatttgtgtttgatgcggcaaagattacatctgcacgtgaaaaattgcaatccttgatgcatgataaatacaaatgccataggccgacaagggttgaggtagtttccgctttgatatggaagtcagcagtgaaatctgctccgcccggttctatatccactgtaacccatgccatgaactttagaaagaaaatggatccaccattacaagatgcgtcattcgggaatctttgtgtggttgttacagcagtattaccagcaacaacggcgacaacaacaaatccagcaaccaaaaaagttagtagtacgagtaatgaagagcaagtggcacttgatgagttaagtgattttgtagccctattgaggcgcgaaatagataaggtaaagggtgataaaggttgcatggagaaaatcattcaaaagttcatctatggtcatgatgcttccgtagcgaaagacagtgatgttgaagataaggtgacagctttgtttatgactagctggtgcaagtttggattctacgaagctgattttggttggggaacgccagtttgggtaactactgttccattaattgagccaaagtacaagaacatggttttcatgaacgatatgaaatgtggtgaaggaattgaagtgtgggtgaattttctggaggatgatatgaccaagttcgaacaccacctaagagagatcctccaactgttttgattttcaaccgtttccctaatagaggtcaattgtcgtgtttgtccatcttaactaccatctttattctcttgttttcatacttgtatttgtcttactccggtaa

SEQ ID NO: 582 - DNA, 1919 bp, Sanguinaria canadensis
caatgaacaacaggaaagtaattagtacgagtcaatatcagttcatacaagcatacatacgtaagaattgagtgacatgacatttgattttattgcgggaaaacaaagaggagttcatgagctgctcagtccaacaaagtaacgaaatcaaggagttcctgatcgcgttcgaatctagccatgtcttcctccaacaagcaaatccaggcttcaattccatctcctgttctgtcatccatcaaaagagaggtgttcttgaatggcagactagcaacagctacccaattcggcttcccccaaccgaaatctgcttcatacaccggaaatctacaccagctagtaaacctatatagctccaattcattcccatttgtttccaatgccatcttcataaactcttgaaactttatgaaccctccatcaccttgaagcaccttcaaggaatcgctgttgattttacgtatcgattccctcattggacccagcagatccatctctccagtactctttgttatggatggtgccactcttgcaactgttgtcgcgagattcccaaatgattgctctggcaatggtgggtccagccttctcctcatgtccacaataatgtttgcaatcgatggttttggggaagaagttgctgccatggcagttttccaaataagtgcagtcacagcctccactcgtgtgggcaaattcttcttcttcttcttctcatcattggaattaccatatcttgctcgaagggttgctattttggtgccatcaaacacaaacctccttgtcactctcttttcggcttgtccagcttgtaccttactggtcaaatgcttattaattgcaccagaaaagggtgaggacattccttctctgggtggatacagaatagctgaatcaaaagtcggactgacaattgattcggggattgcctgacgagtgatggaagcccaagtattgataaatgtggtcaatgttgctgcgtcggctagcttatgtgaaatggaaacagaaattgctattccaccacagtcaaacaagttgacttgaacgatcaaatgtgaatcgttaccaacaattacattcaaggtagattggaaatcataaggtaggagatgatgcagttcatctcgtttcataaaatcagaaattttaccgttgactcgagattcgaaatactcaataccttcatcgctacaatccaccaagagcttatctttgatccttcctgctaacgggtagaagagggtcaaggtctccgatagagacttcttgagctgattagatacacctagctgatgatcatcatcaagagtagttgtgggactagagtagaagagaatgatggggacaaaaactggatgagcgagctgatcaagaagagacagcctgaaggttcgaaggtgatcgggggttggagttgcccacaaaatcgaattcaaagaaggccctgctttgcctgttcttgatcaaatgcttgaagatggaaactatcatggatcgtacgatttcatcttcgttgatgctgataaagataattacattaattaccacaagagattaatcgatctagtgaaaattggaggagtgatcgggtacgacaacactctatggaacggctcagttgtggccccaccagatgcaccattgagaaagtacgtaaggtattacaaagactttgtgttggaactcaacaaagctttggctgctgatccaaggatcgagatttgtcaactccctgttggtgatggtatcactctttgccgccgtatcagctaatcatttcccatcacataaaaaatatcccgggaaaatttttattttcccttcgcaaatattttcctttttaatttgtgtcgtgaatgaatgattagggttgcttggttaagtcaatgactcgcacttccacttgtatttttttt

SEQ ID NO: 583 - DNA, 1634 bp, Stylophorum diphyllum
tgtgatgtaattaagaagtccttgacgtaccactaagccagaagatcggaacaccatggaaatgaaggtcgaagtggtgtcgggagagaccattaaaccatcttctcctacttctcaacaccttagaaccttcaacatatcctttcttgatcagattgctccccccatttatattcctctcgttcttttctacacaaccaacggcgatagtgacagtaagtctcgttgtgatgtaattaagaagtccttgtctgagagcttaactagattttatccgttagccggaaagatcaaagatgagggttctgttgactgtaacgatgatggtgttgattatttggaagccaaagtcactaatagtcgactctctcatgttatacaacaccccgatgtccatgcacttcaacaattcctgccatgtgagccctatagttctgatcagtccgcacccaattcgaaagttctcctagccatacaggtcaacgtttttgaggattgtggtggaatggtgatcggtatttgcatctcgcacaggctagctgatgcatcttctttgagcacttttattaacgactggactgcgaccgctcgtggtgctactgagcaaatcaaggctccttatttcaaattgccaactctattccccaaggtagatttaaagggttttactcctccaggaggtatcaagaaaaaccaccgaaaaattgtgacaaagaggtttgtgtttgaggcctccaagatagctgaactcaagaaacaaagtggaaaattagccaatactaatatcaatggcggatctgataaaattcaagagtacccaacccgtgtggaagctttgtcggctttcatttggaagcgtttcatcgaattggatcaagctaaagaaggagctacaacatctgcaagggagtattcgttgacacatgcagtgaatttgaggaaaaagacggttccaccgttgccaacagatgcttttggcaatatgtacagttctacgtttgcagtgctcattgacaccgatggcaagtatgatcatccgtacccaaacttggttggaaaagttagagaggccatagagagaattgatggttttcatgttagaaaactgcaaagtactgatgcatacttcaatttttacaagaaacggatggaaaacgctgtttcgagtggtcagataccaaaagtgttgctacactttagtagttggtgcagattctctatatatgaagcagattttggatggggaaagccaacatgggcaacaactgctccactcccattcgagaatgttgttgtgttcatggacacgagatcaggagacggaatagaagcatgggtgaacatggttaaagaagacatggatgaattcgaatgtgacaaggaactctgctcgtttgtttcttagtttcctagtcgacccaaaaactcgatagtaacttaattctcattcaaacgagtctgatgagaagatctatccatattcaagaatgtatactagctgttaatttcctgctaaagtttttcaaatttcttcgctacaacggtttcttttcctatgttttgatgtccttagttttagaaatattactctgtgattgatatttgaatattgtgttactctgtggttgatattt

SEQ ID NO: 584 - DNA, 665 bp, Stylophorum diphyllum
aacggatggcatcgctgattgagatgccaattgttcgttaggtgagaaaagagatgccgagtcgaaagaaggaagaaacaacggatttgtgtttggaggaccgatagctcccccaagacgagctgtgttggtggtggctgcccaataacgagtgaatgtactcatggtgcatgcatctgcaatcttgtgtgatatacacaaacaaatggctgctccaccgcaatcaaatatgttcacttgaacaatcacctgtgcttccttaacgaagttcatggaaacgactccagatgggagaagcagacttaagcgtacatctggattcatcatgaagtcgcacaaattactcttgatttttacttcgataaagtcgatgccttcatcgttacagtcgactacaatgttgtctttcatcctaccggccagtggataaaattgacccagcgtttcagaaagagaactcttaagcaagttaagatcatcgtggtgtttactaccagaactattagtgactgcagcagggtagaaaagaatgattggaacataaactataggacaatattgatcaagaagggacagattgaagtttctaagttgatatggggttggagttgtgggtttaattgtttccttggagattcacttcgacatcaacactagaacaaagc

SEQ ID NO: 585 - DNA, 1792 bp, Tinospora cordifolia
cgggatcaaatcgaacttattacatcaattttgttcaatttttaggtttagtcaattttgttgaacacccctaattctaaaaatgaaaaaaccgacttcccaaccaaccatatatagatgatatacatagatagtgcaataagaacaaagcactgcaaccattgtttcaaaattgtagttaaagatacttccctgttaaaaggacacaaaggagaggaactcttgatcatgttccaactcatccatgtcttcttccaacatgttcaaccatgcttctattccaccaccacatcttgtgtctatcaaaatgataagattcctaccaagtgtcttggttgtgctaacccaaacaggctttccccacccaaagtctgcttcatagaaagggaacctacaccaactgttgaagttcaacacaagtagctcctcctttgagaagtttttccttgcttcttcaaatgatttcacgaacccttcttctccacattgaagtttccttacataatctccatccattccccttattgcatctctcaaatgctttaccaaggcatggctttctgtttcactctccaagttcacaatttctgttattgcaggtctagaagcattcccaaatctatgatttggagaagcaggcaccatccttcccctcaaattcactgcatgaagtgctgcagatgcccttaaaggtccagctcttgcccgagcagctcttattgcgtgcttccatatgaacgccgaaactgcttctactctagttgggtactcctcctttgagtttttcttagagttattaaaaattatttcacctcttagagcatctatcttcttgccatcaaatacaaaccttctggtgacgatgttgtctaccattcccaccccacttggagctattaatccatttgaatctttcgccgggaagagcgaagacaaatcaaagaacagatttggaatagattcagtggatccattaatagcagtggaagcccaacaatttataaatgtcgccattgatgcaccatcagcaatcttgtgtgaaaagcagaagcctagagcaattccaccgcagtcgaagtaggtggtttggatcgctaggagtgaattggagcacagtgcttcattagtcgtcacataaggatcacacggaaggaatttactgagttcatcaatgttgggtcgtatgagaaaatccgacagtctagtattcttcactctagcttccaagaactcgactcccttgtcgttgcaatcgagggtgacgccgtttactatccttccagccactgggtagaaatgggtcaaggtttctgataaagatttcttgagctgatcggatctctttaagtgttctacttgatttttgtcttcatcagtactgtaaggtggatagaagagaatgatggtgacatagttagaagtagcttgctgatctaaataggagagtttgaaggatttcaggtgatcaggagttggagttgatggtgaaactttgtctcttgagatgatctgaatctccatttctcttgcccataaataaagtcgtgatcattaaaataaagctatagagtgattgagctaatggttggagatcaagcaaccgcaggttcacgtaaattagtaggaacaaaagccgccaagaccacgtaattttcaaaataaataataaataaataaaggcagagaacagggaggaatatgagtaaggtacgaggatggcagcagagaagatcagagagcatttgcagagatggtggaaaggttatcctaatcctctctctctctctctctc

SEQ ID NO: 586 - DNA, 1444 bp, Thalictrum flavum
acaaccaacatccacaatcgtgatcatcaccttttcttcaatactacttacaaattacaacaatacatagaattaatgaacccataatgaacatctaattgagttctaagccagatttggctgaagtgaaggtaatgatgtcaggctcacactcaaaactagccatgtcttcttcaatcaaagaaacccatgcttcaattccattgccacaattagtatccattaacataatgatgttcttagcaaccaagttaacactggttaaccaacttggtttcccccacccaaaatctgcttcatagaaagggaacctacaccaactggtaataacgtaagcttccagttcacctttgacatccatttcaaagaaccttatggtagaatcataaagctcggaaagcccattatcagattgaagttttttaacatagccactgtcaatactccttaacccttttcgtaactgactcaccaaggaatgaaatttttgctgtatatctgtgcttgactctactgacttaccaatcattagatttccaacaaaatcgttagacaaaggtggatccattcttccgcgaagattcactgcaaagtttaccacagatgctgatgaccttagggactttgttctcattcttaccgcattcatggcacatctccatatgagtgctgaaactacctctaccctcgttgggttttcaattgcatctttagttatagctctgagtgccgcaatattagacgcatcaaagataaaccttttactgacaaccttgtgtggacttcctatgggaggcataggagatggtatatctttgggagggaacagagatgtcatgttaaacttgggatggagtagtttactatctccccttgaaagggatgcccaattattgaggaaaacactcatagaagagccatcaagaagtttatgtgatgtacacacagcaagtatcattcctccacaagagaagatattcacttgaatggatagtaatacctttggacccaatccatagaactcatctattcttgggagtaattggtctagctcctgaggtataggattgttcagaacttgcttgagttcaccactaattcgggcttctgaaaagctgacaccctcatcactacaatcaatagcttcatgaccagtgatccttcctgctaatggataaaattgtgttaagacctcagataaggattcctttagacgattagtatgtgcagtattttcgactttgttgtgttcattggcagagtagaatagtaggacaggcacatgaactggaggagcgtattgatctactagagatagttgaaaagttttaaggtgattgggtgttggagaagatggtttaatggtttcttcagagataacctcaacattaagtgtcatcttgttccttatgaatatttctagtagacataaagatggaagctc

SEQ ID NO: 587 - DNA, 1486 bp, Xanthoriza simplicissima
caaatattcaaatgagaacacaaagggcaaaatgacactggatattaacgttctctctcaagaaactatcacaccatcctcttcaacacccaatcacctcagaaacttcaagctctcccttgtagatcagtatgctcctccagtgcatatttctgtcattctattttaccctgccaacatcaatgacagagtaaaaattgatgagcgaactcatcgtttaaaaagatccttgtcggagatcttaactcatttctacccgttaggtggaaagatcaataataatcaatttatcgactgtactgatgagggagtcaacttcttcgaaactcgagttaatggtcgtcaactgagccaagttctcaaccatcctataccagaggagctggagcaattacttaacaaagatgacttctatagattgggtccaaaggcactgttatccattcaagccaacatctttgactgtggaggaatggcacttggtgtttgcatatctcacaaagctgccgatggctcttctttcggattattccttaataactgggccgccatcacaagggaggacaacggaattcctcaaccaatacttggccagacatcgcttttccctcctaaagatgatgtgttctcttatgtacctgccggtgtaagctcaataccaaaggttgttaataaaatatttgtcttcaatgcaggaaatatagctgccctcaaggctaaagcttcccacaaattatatgtagaacaccctacacgggtagaggcagtttctgcactcttatggcggtgtgcaaggaacgcgttaagaacgagacctggatctgcaaactcagcatctgtcgcgactcttgcaatgaatctgcgcgggaacatggttccagcgttgtctaatctctctttcggaaatctcatgattggtacaatagcaacatcaaatacggaaagcgccccagagttgccttgtttggtgggtgagttgcgggaagcgaaaatgaaagttgacgttgattatgtgagaaaacttcaagttgatgatggagtttccgagttatggaattctttcatggatctgaatgcacgacatatcaaaggtgaactggaactttacacaatttccagttggtgcgggtttcctttctatgaagctgatttcggatgggggaagccaatgtggataacctctgttaatctgtttgccccgaatattttcattttaatggatagtaaatgtggcaatggagtagaagcatgtgttaccttggatgaagaagttatggctagattcgaatgtgagcctgagctcattgccttcacttccaccactcgatcagctgcctgaagattgtaatatatagaccatattcattatgtcccatatttacttggtaatgaaatgtagccatattgcgatctctgatgaatttcatggtttatctttgccgatttggcttgctagattattatggtgagaactgaaaacagtcac

SEQ ID NO: 588 - DNA, 1071 bp, Argemone mexicana
atgggtgtaaatgataaacaagatcaaaatcaagaggttgacattaaagatcaagctcatctctggaatataatttatgggtttgctgattcacttgttcttcgttgtgcagtagagattggaattgcagatattataaaaaacaataatgggtcaatctctgtttcagaacttgcatcaaaactcccaatttcaaatgtaaattctgataatttatatagaattctaagatacttagtacatatgagtatcttaaaagaagaaacatcatcagacattaatggtggaaacaagctttactcacttcaaccagttggtactttactcttaagagatgcagagagaagtatggtacctatgattttaggtatgactcaaaaggattttatgattccatggcattttatgaaagaaggattaggaaatggggaaacagcatttgagaaaggaatgggaatgacaatatgggaatatttagaaggtcatcctgatcagagtcaattatttaatgaaggaatggctggagaaacaagacttctaactaaatcattaattaatggttgtagagatatttttgaaggtttaaattctcttgttgatgttggtggaggaaatggaacaacaattagggctatttataatgcttttcctcatataaaatgtaaactttatgatctacctcatgttattgctaactctcttgatcaaccaaatattgaatgtattcctggtgatatgttcaagtttgttcctactgctcaagcaatcttactcaagttgatcttgcatgattggactgatgaagagtgtgttaacattctaaagaagtgtaaagaagcaataccaaaagaaacagggaaagtaatcatagtagatgtagcacttgaagaagaatcaaaacatgaacttacaaagacaagattgattcttgatattgatatgttggtaaacactggtggtagagaaagaactgcagatgattgggaaaatttgctgaaacgtgcaggttttagatctcataaaattagatccattgcagctattcagtctgtcattgaagcttatccatag

SEQ ID NO: 589 - DNA, 1074 bp, Argemone mexicana
atggaagtcaacaagattgatcaagaaaaccaatcaaaaatttggaaacaaatttatggttttgcagattcattagttcttaaatgtgcagttcaattagaaattgctgaaacaattcataatcatggaaaacccatgtctctatctgaattagcttcaaaattaccgattcaacccattaatttggatcgtttatacagagttatgcgttatttagttcatatgaagctcttcaacaaagaaattatcaccattaatggagatatcaataatacagaaacagtgattaaatactcattagctccacctgcaaaatatttaataagaggttgggaaaaatcaatggttgcttcaatattagcaattaatgataaagatttcttagcaccttggcatcatttaaaagaaggtttaactggtaattgtgatgcttttgagaaagcattaggtaaaagtatatgggtttttatgagtgaaaacccagaaaaaaataaactttttaatgaagcaatggcttgtgatactagattagttacttcagctttagttaatgaatgtaagaatattttttgtgatgatggaattaaaaccctagttgatgttggtggtggtactggtacagccatgaaagctatttctaaagcttttccaaatatcaattgtactatttatgatcttcctcatgttattgctgattctcctgagatcccaaatattactaaaattgctggagatatgttcaagtctattccttctgctgatgccatcttaatgaagtgcatccttcatgattgggatgatgaggaatgcattaaaattctaaagttatgtaaagaagcagtaccaagaaaaggaggaaaagttattatagttgatgtggtgttaaacatggatatgactcatccatattcaaagattagattgacattggatttagatatgatgcttaacactggaggaaaagaaagaacagaagaagaatggaagaaattatttgatgctgctggttttgctacttataaaattactcaaatttctgcagttcaatctgtaattgaagcttatccttattaa

SEQ ID NO: 590 - DNA, 950 bp, Argemone mexicana
atggaagtgaaaaagagtgatcaagctctccaagctaaaacatggaagattatctatggctttgcggaatcgcaagtccttaaatgtgccgttgagctcgatatcgctagcacaattcataatcatggtcagcccatgactctatccgaattagcctctaaacttccagtgcaacagcccatcaattcagatcacttatacagagtcatgcgttacttggttcacatgaagctcttcacctccattaatggtgatgtgatcagatatggacttgaaccaccagctaaataccttataaaagtttgggaaaagtctatggttccttcaatactatcacttcaagataatgttttatttacaccttggaatcaccttaaggatgcgatgaccggtaattctaatgctttcgagaaagtgtttgggaagagtatatgggaatacatgagtgagcatcctgataaaaacaagatctttaatgagtccatggcttgtaacagtaggtttcttatatctgctctagtaaatgattgtaagagtgtctttgaagggttaaatacgcttgttgatgtcggtggaggtactggaactactgcaaaagccatctcaaaggctttcccttacataaaatgcactgtctatgatctacctcatgtcattgctgattcccctagtgatcctgatattgtttatgtccccggcgacatgttcaagttcattccaagcgctgatgccgtcttgctaaagtggattcttcatgattgggatgataaagaatgtattcagattctaaagctatgcaaagaagtagtacctcgagaaggagggaagattattatcgttgatatcgtacttaacactaaaaattctaatgagcatccttacaccaagatgagacttaggtttgacttgggtatgatgcttaaaacaggaggaaaagaaagaacagaaga

SEQ ID NO: 591 - DNA, 1074 bp, Argemone mexicana
atggaaatcaaattagaagatcaagaacaagaaatgaaatatcaaggtcaagtttggaatcttatatgtggtaatgttgattcatcagtactgaaatgtactattgaattaggtcttcttgatataattcatcaaaattcaaaaaaacccataaccctaattgaattatcatcatcttcaaaatctttatcttcactcaaaacccaaaatttatatagattattaagatacttatctcatatgaatctaattaccattaattcaaaagaagaaggaaaagatgaaacattttcattaacagatttatctaatttattacttagtaatcaagaaagaagtttaaaagattgggttctaggtatagatgatgaacattcgattaatgtttggcatgaattaagtagctattgttcttcaccagaggatgcaccaacaccttttgtgaagttgaatgggaaaacattatgggaattagctgaagaaattcctgaagtgaatcaacttattaataatggaatggcttctgatacaaaaatggtaatgcctgcatttgttgaaggttgtggtaagattttgaatgaaattaaagaattagttgatattggtggtggtacaggtgctgctatgggttatgttgttagggcttttcctcatataaaatgtactgtttttgatcttcctcatgttgttgctactgcacctaagattcctggtgttgaaatgattggtggtgatatgtttgaattcattcctcctgctgatgctcttctattgaagttcatgcttcataattggaaagatgaggaatgcataaaactattaaagaaatgtaaggaaacaattcctgtggatgaaggaaaagtggtaatagtggaaatggttttggatcaagatgaagacgaccatgatttaacacaagctaggttaagtctggatcttgatatgatgttgagttcaggaggaaaagaaaggaccaaagaagaatggagaattctacttaaaaaagctggttttaataagattgaattcattcctatttttgcaattcaatctgttattgttgcatatccttag

SEQ ID NO: 592 - DNA, 1101 bp, Argemone mexicana
atgaacacaaccacagagctgatcccaccaacacttcaagtaaatgatgaagaagaagcagcagcttgcatgtttgccatgcaattagcaagtgcttctgtattgcctatggttctcaaatcggccattgagcttaaccttcttgaggccattgctaaagctggtccgggtgcctatgtttcgccttccgagcttgcggctggccttccttcgagccagcctgacacacctgtcatgcttgaccgcatccttcggcttctagccagctactctgttctcaagtgtgaacttcgtgacctgcctcacggtcgggttgagaggctttatggattggctcctgtgtgcaagttcttgaccaaaaattctgatggtgtgtctatggctccacttttgctcatgaaccaagacaaaatccttatggagagctggtatcacttgaaagatgccgttgtcgatggtggaataccttttaacaaggcatatggaatgacagcatttgagtaccatggcaaagaccccagatttaacaaagtcttcaaccagggaatgtcgaatcattctactattactatgaagaaaatcctcgaaacatacaatggttttgccggtctcaacactctggtggatgttggcggaggcactggagccacccttaatatgattatctctaaatatcctaatcttaaagggattaactttgatctcccccacgtcgttgaagatgctccatcttatcctggagtggagcatgttggaggtgacatgtttgttagcgtgccgaaaggggatgctattttcatgaagtggatatgtcacgattggagcgatgcacattgtctggcgttcttaaagaactgctacaaggcacttccaaataatggaaaggtgatactagcggaatgcattcttccagaggctccggactcggaacttacaaccaagaatgtcattcatatagatgttataatgcttgcacataatcctggtggaaaagaaagaactgagaaagattttgaggccttgggaaaagaggctggtttcagaagctttaacaaggcctgctgtgcttataatacttggattatcgaatattataaatag

SEQ ID NO: 593 - DNA, 1107 bp, Argemone mexicana
atgggttcaaatcatcaaaacgaaataaacaagagcagtaaagaagaagaagaagaaaaagcatgtatgtatgcattacaattagctagtgcttcagtaccagtcatggtgttaagagcagtaattgaacttgatgttctcgagattattgcgaaagctggtgaaggtgttgaactttctgctgcatatattgcatcacagatccctaatattaaaaaccctaatgcatctgttatgcttgatcgtatgttgcgattactgtctagttataagatccttacttgttcaattagagatcttgatgatggcagtgttgaaagagcttatggacttgaacttgtttgtaaatttcttgttaagaatgaagatggtgtttcaatggcttctctccttttgatgaatcaagataaggtctttttggagagctggtaccatttaaaagatgcagttcttagcgggggtatcccattcaatatggcatatggtatgaacgcattcgagtaccaagccacagatccaaggttcaacaagatctttaacaagggaatgtctgatcatacaacaatatgtatgaagaaaattttagaaacatacaaaggttttgaaggattaaattcaatcatagatgtcggtggtggtatcggtgttaccctaaacatgatagttacaaagtacccaaccattaagggtattaacttcgacttacctcacgtaatcaaagacgcacccacttatccaggagtcgaacacgtaggaggagatatgtttgttagtattccaaaaggaactgatgctatattcatgaaatggattctacatgattggagtgatgaatccagtatcaaaattttgaagaattgttatgaagctttacctaaacatggaaaattgatacttgttgaatgtattattcctgcaactactgaaccaagtcttgaaggtttaggtgtttttcatgttgataatattatgatggcttataaccctggtggtaaagaaaggactgagaaggagtttgaaaccctagctaaaggtactgggttttctagtattaaacttatatgttgtgcttttaacacttggattatggagtgctataaaaactag

SEQ ID NO: 594 - DNA, 1116 bp, Argemone mexicana
atggatgtcaataatggtattgtagaaacaagcatttacatgtcaagagtagggaagttagggagttactcagccatttcaatggcattaagagcagcaattgagttaaatttatttgaaatcatctcaggatttggaccagaagcacaagtttctgcaactgacttagtttctaaaatgtccaacataatcaataaccctaatgcacccatctttctagacagaatacttagattgttgggtgtaagctctatcctatccatgtctacgagggctatttcgccattatcgtcgtcaaatggaaaaatcatgaacaaagtggaaagggtttacggtttaacggaagaatctcgttctttggttcctcgcgaggaggatggagtatcgttgttaccaaccttaatgttcactaccagtaagttggttgtggagagcttctttaatttgaaaggagtggttctacaaaaaaattatgtcccatttgatatgactcatggggttagtatatttgagtatgcttgtaatgaaccaaaattgaacaaaggattcaatgaagccatgggattttttagcgtgattgtttttgaagaagtttttagggtttataatgggtttgttggtatgaaagaattgttagatgttggtggtggtactggtacttccattagtaagattgtctccaagtatccatctattcatggtatcaactttgatttgtctcatgttatttctgttgctcctcaatacccaggtattgagaatattgcaggagatatgtttgaagaggtaccaaaggcacagaatatcttgcttaagtgggtacttcacgactgggacgatgaacgatgcgtgaaaatactaaagaattgttggaagtcattggggtatgaaggtgggaaggttttggtgatggagtttgttcttcctgatgaattaggtgacaatacacaaacatacaacgctttagtacctgatctccttatgatggcattgaatccaggcggtaaagaacgtaccctttccgaatatacggaactagccaatgcttctggatttctaaaaaccaaatcataccctatttctcatggtcttcgtgtcatcgagttccataaataa

SEQ ID NO: 595 - DNA, 1086 bp, Argemone mexicana
atgggttcaacccaaaaccaagatgaagaaacacaagcatgtatgtatgctatgcaattagcaagtgcaagtgtaccagttatggttttaaaaacagttattgaattagatgttttagaaattataaagaaatctggtccttgttcaaaattaagtgctactgaaatttcatctcaaatcccaaatctcaagaatcctgatgcacctgttatgcttgatcgtatgcttagattattagctagttataatatcttaacttgttctctcaaagagcaagatcaagatttgaaaattgagagagtttatggacttgctcctgtttgtaaattcttgactaagaatgaagctggttgttcgatgtctgctttacttcttatgaatcaagataaggtcctcatggaaagctggtaccatttgaaagatgctgttcttgatggaggaatcccatttaacaaagcatatggtatgtcagcatttgagtaccatggaacagaccctagattcaacaaagtctttaacaaaggaatgtctgatcacacaaccataaccatgaacaaaattcttgaaacctacaagggtttcgaaggattgaattcgatcgtagacgttggtggaggtatcggtgccaccattaacatgatcatctccaagtacccaacaatcaaaggtattaacttcgacttgcctcacgtaatcgaagacgcgccatcattcccaggggtgaaacacatggggggtgacatgtttggtagcattccaaatggagaagcaattttcatgaaatggatacttcatgattggagtgatgaacacagtttaaaaatcttgaagaattgttatgaagcattacctaaaaatgggaaagtaatattagttgaatgcattataccagaaataccagatagtaatgtttcaacaggtcatggtgttttccatttagacaacattatgttggctcataaccctggtggtaaagagagatcacagaaagaatttgaaaccctagctaaacagacaggatttactgattttaaagttgtttgttctgcttatgacacttatgttatggagttttctaagaactaa

SEQ ID NO: 596 - DNA, 1076 bp, Argemone mexicana
atgtcaaaagaagttaaaggtgccgatgaatttgcaatgggactgcagttaaacggtggcacagttcttggaatggttacgaaaacagctattgaacttgatttatttgagatcatagctaaggcttctactgtaaatggtatctctcctttcggagatgatgctaaaaaattgtccagtgatgatattgtagctcaacttcctacgcaaaatcctgcagctccggcaatgcttgacagaattcttcggtttctggctgccaagtccattcttaactggaccacaatagtccaagaagatggcaaagagaagagtctgtttagtttaacgagtacatgcaaatattacatttctgatgaagatggagtttcactagctcctacgttggtcatgcttcatgacaaagttatcattgattcttggtatcgcttgaaagatgcagtgcttgagggaggaatcccctttaacaaagctcatgatggcatgcatgcatttgaataccctgcaatagacagcagattcaatgatgttttcaatcaaggaatgtataatcacaccactcttctcatgaagaaaattctagaggtttacactggattcgaagagatcacagaaattgtagacgttggtggtggaacaggggcaacgctagccaagatcatatccaagtatcccctgattcggggaatcaactttgatttacctcatgtcatcaagaatgctgctcctttagccggtgtggagcatgttggaggagatatgttcgaaagtgtcccaaaaggagaagtcatcttcatgaagtggatacttcatgattggagcgacgatcactgcttaaaacttttaaagaattgctgcaactcccttcctgaatttggcaaggtgataattgtggaatcagtagtgcctgaatactccgacaaaggttcttcggcggaattagacaatgccgttaatggtgatatgatcatgttggcattgaatcctggaggaaaagagaggagtttaaaagaatttgaggaattggcaaaagagtctggatttgcagctgtaaaactcatttgcagcgcctctgt

SEQ ID NO: 597 - DNA, 1053 bp, Berberis thunbergii
atggagttgaatggaaaggatgagtctgtagacattaaagcacaagctcatctatggaagatcatatatggctttgctgattcccttgtccttcgatgtgctgtagagcttgggatagcggatatcatcaacgacaacaaccagcctatcacactccctgaccttgctgccaaactcccagtctccaatgtgaattttgatcacttgtatcgaattcttcggtacttagcccacatgaagctgatcaaacaagaggagaaacgaggtgttacactctactcacttgaaccaattggaacaatgttggtaaagaatgcaaagagaaacatggttccaattatccttggaatgacccaaaaggacttcatgacttcatggcatttcatgaaggatggtttgagcaacgacggtaccactgcctttgagaaggggatggggatgaccatatgggagtatcttgaaggtcacccagagcagagtcagttgttcaatgaagggatggctggtgaaactaggcttcttacttcttcactcattaatgggagtagagacttgtttaaaggtatcaattctcttgtggatgttggaggaggcaatgggactaccattaaggccatatctgatgcttttcctcatattaagtgcacactatatgacctccctcatgtcgtcgccaactcttatgatcttcccaatgttgaacgcattcctggggacatgtttcaatctgtgcccagtgcccaggctatcttgctcaagctaattttgcatgactggagtgatgaggactgcatcaagatcctaaagaaatgcaaggaagcagtgccaaaagagggagggaaagtgataatagtggatgtggcattggatgaggagtctgatcatgagcttaccagtacaagattgatccttgatatagacatgttggtgaacactggtggtaaagagaggtctaaggaagattgggacaagctcatcaaagctgcaggctttaaaggattcaatatcaggcacattgctgcagtacagtctgtgattgaagtcttcccatag

SEQ ID NO: 598 - DNA, 1062 bp, Berberis thunbergii
atggctgctaattctgaaatggtggaagaaaacatcatagctaaccaagctaagctctggaactccatctatggattttcagagacatttgtgttgagatgtgcagtagagcttgacattgctactatcattcacaaccatggaaagtccatgacactctctgagttagtttcacagctcacagtgaaacaaccggttaactcagatagtttgtcccgattgatgcgatacttggtatacatagacatcttcactgatacagtagatgtagacagagaaaccagatatggacttgcaccacttggtaaatttttggttaaagggtcggatcactgcgtggttgaggaaatgttggtggtcactgataaggagttcatggctccatggcaatgcatcaaggatggcatcacagatggcagcaagactgcttttgaaaaaacatttgggatgaatatatgggagtacatgggaaagcactcggaaaagaatactaccttcaatgaattcatggcaagtgactctagaatcatgtcatcagagttggtaaacaaatgcaaagataagttccaagggttaaattccttagtggatgttggcggtgggactggaactactgctaggagtattgccaaggcatttccaagcataaaatgcacagtttatgatctacccatcgttcttgccgattcccttgtttgccctgaaattactcaagtctcgggtgacatgtttaagtttgtaccttctgcagatgccgtcctgttgaagtacattcttcatgattggggtgataaagaatgtattgaaatcctaaagagatgcaaagatgcagtgcccaaagatgttggaaaggttatcatcatagacactgtactagatgtgaagtcagaccatccttacacaaagttaaaacttagtttggatctagacatgatgattaacacaggagggaaggagaggagtgaagaggaatggaagacactcatccaagctgctggatttaaaaactacaatataactcaattatctgctctaccttcagtcattgaggcttttccctag

SEQ ID NO: 599 - DNA, 1050 bp, Berberis thunbergii
atggaagaagaaagcatagcccaccaagctaaattatggaatatcatctatgccttttcagactcacttgtgttgagatgtgcagtagagcttgatattgctaatatcattcacaaccatggaaagcccatgacactctctgaattggcttcagtgcttcctgtgaaacaacctgttaattcggatagcttgtaccgcgtaatgcgttacttggcacacttaaaagtcttcactaagacattggatgcagatggagaaaccagatatgggctcgcaccaccggctaaatttttggttaaagggaatgatatgtgcatggttggctcactaatggggcttactgataaggatttcatggctccatggcagtacatcaaggatgttctatcaggtgatgatggtaagactgcttttgaaaaagcattaggaatggatatatgggaatacatgggagagaacccagagaagaacaagttgttcaacgaagcaatggcatgtgacacgagactcgttttgtctgccttgatcaacgaatgcaaggacaaattccaagggataaattctctggttgatgttggtggtggcactggaactgctgcccggaaccttgtcaaggcattcccacatttgaagtgcacagcttatgatctacctcatgtcattgctgactcccctgtttaccctgaaatcaatcaagtcccaggagacatgtttaaggtcataccaaatgctgatgccatcctgatgaagtgcatccttcatgattggggtgataaagagtgcattgaaatcctaaagaaatgcaaagaagcattgcctaaagaaggtggaaaggttattatcgtcgacattgtcctagatgtgaaatcagaacatccatacacaaagttgagacttactttggatgtagacatgatgctcaacactggtggagggaaagaaaggactgaagaggagtggaagaaactcattcaagctgctggttttaaaagctataacatcactcaaatatctgctctacaatcggtgattgaggcgtttccttattaa

SEQ ID NO: 600 - DNA, 1110 bp, Berberis thunbergii
atggctccacaaatgtgcagtgagatcctcaatggagatggaggtgaggatcttcttggagtacaagctcatatctggaaccacttattcaacttcattagctccatgtccctcaagtgtgcggttgaattgcagataccagacatcattcatgattatcctaaaagccctgtcactctctctgaattggttgcagcactaggaatccccgaaacaaagtctacacatctttaccgcctcatgcgcctattagtccattctggcttttttgctatacgaaaagtacatgacactctggaggaaaaagaaggttatgtgctaacaccttcgtccaaactacttcttagaaatcataacaagagcatgtcaccgtttttgttaatgatattagatccggccattgtcaatccttttcattttcttagtgaatggttccagagtgatgagatgatcacaccatttgaggctagaaacggggtgccatttttcaggtattttggtgagaacgaccaagttcttgggaaaatgtttgatgagtccatgggttgtgatgctcaactggtgatgagtgttgtgttgaaggagtgtaaagcgaagtttgagggattgaagtctttggttgatgttgggggaggtattggaaccgttgccaaggtcattgctgaaaccttccctggtgtgaagtgcactgtgcttgatttaccgcaagtggtgggaagcttgatagggagtgctaatgtggaatttgttagcggggacatgtttgagttcatcccatctgcccatgcagttttcttaaagtggatcatgcatgattggagtgacgaggaatgtgtgaagatactaaagcactgcaaggaagcaattccatccaaagaggaaggagggaaagtgatcataatagacatggttgtcaatgactctaataataaaggcaactatgaatcgactgaaacgcaactagtatttgacttgttgatcatgagtttactccccggaagagagagaactgaggctgaatgggagaagctctttctagatgctggtttcagtagctacaatattactcctgttttgggtctaaggtctttaattgaagtatttccgtag

SEQ ID NO: 601 - DNA, 1038 bp, Berberis thunbergii
atggaggaaaacatcaaagcacaggctctgttgtggaaatacatctatggttttgcagattcattcgttctgaaatgcgcgatccaactcggtattgcagatatactgcatgaacatggccaacccatgaccctttccgagctggccacttctctcccacatccttccatcaacgaagatcgcctgtacaggttcatgcgttacttagttcacatgaaactcttgggtaaagttgagttggatggattgatcaaatactcactcaccccagaatcgaaacttgtaatcaagaaccaagagaaaagtcttgcatcatttgctctcctactgtcctacgagatggatgcgtggcatcatttgagtgcatcagttgaaggtggtgatctgacaccattcgagaggtgtaagggcatggggtatagagagtactttgcaaaaaactctgcagcgaaccagttgctgagtgatgctatgacgagtcacacgagtatggtgacagatgcggtggtgaagggatttgagaaagctcatgtgcttgatggcatgacttccctgattgatgttggtgggagtacgggtgtagctgctcgcgcaatagcaaaggcgtttccggaggtcaagtgtgcggtatttgatctgcctcatgtgattgccactgcaccggagtgtcctgaggtgactcggatagaaggagacgtattcgtatctcttcccaaaactgatttagtcttcatgaagtcagttttgcacgattggggtgatgaggactgtgtgaagatattgaacaagtgcaaggaagccatagctgatagcaaacaaggaaagattgtgttagtagagatagtgatggatgcagtgtcaacggatgatgagttcaaaagtgccaaattggggatggagatggacatgttggtcactgttgctggcaaagagaggagtgagcaagagtggcagagactcttcaaggctgctggttacagccgataccacatcacacccatcgtggccattgaatctatcatccaagttttcccttaa

SEQ ID NO: 602 - DNA, 999 bp, Berberis thunbergii
atgtatggcttcgtcaactccatgaccctcaaatgcgcgcttcaactaggcctaccagacctcatccacaaacacggtgagcccatgaccttaacacagctcgttaactccatcccagttccatctcctgacccggactacttgttccggatcatgcgctttctagtccagaacaaccttttcacatgcagtgaagatgaaaaatcaggtgagctgaagtacgggttgactccggaatctgaattgttggtgatgaatcatgataagagcttggcaaagtttgtactccaggcaatgcatctgaatcaaatgtcagcttggcaacatttgatagacggtcttggttgtgatacgtatccatggatggtgtgtcacaagacgacttggcatgaatctgcagtcaaggacgtggaatgcctccagttgtatattgactctatgaaatcgtataccactcatgttgtggagcctctggtgagtggttgtataggtgagtgtgtgtttgataatgtaaacaccatcgtcgatattggtggaaacactggcattactgcaaaggcggtcgttgatgcttttccggatgtgaaagttacagtgatggatttacaagaggtgatcgatcagccccatatagaccatcctagaattgagtatctggcgggcgatgctttttccttcattcccaaggctgatgtgatctttatgaagtcatttctgcatggttacagtgaagaacagtgtattgaagtcctgaagaaatgcaaggaagcaatcccactgaagactggaaaagtggtattggtagagattgcagttgatgctgaagggtttccagagtttgcgatgccaaaattgtgcatggacatggaaatgctaatagtagggggaaaagagaggaacataaaagattgggcaaacatattaaccaaagctggatttactcaacacaagatcatacccattgcagctttggaatccatcatcgaggctcgcccttga

SEQ ID NO: 603 - DNA, 1074 bp, Berberis thunbergii
atggagaccattgtgggaaataggaagcaaatggaggaagatgatgaagagatcaaagcacgagcccaaatatggaagcacatgtatgggtttgctgaaacaatggtgctacggtgtgccttacaactaaacatacccgacataatccacaaacacgggccaatgacattaccggaattggcaagcaaattaccactcggttcaactaatattgacagactccatcatgttatgaggtacttagtccacatgaatttgtttacatctaggccatcggagaccagtaaagtgataacttatggccagacggcagcgtcaaagctcctactgaaggaccatgagaacagcttgtgcccatatgctatgttacaaacacacccagaagcattttcaatgtgggctcatattgtggaaagcttggatggatcaaaggcttattgggattcaacttatggggagtctctgtatcagaagatagagaacgaacctgcccatatgaagatggttaacgacgccatgaccagtcatactaggtccatagcccgggcagtagtgtcagggttggcgagggaacaggttctcaatggggttgggtcacttatggatgttggaggcaattcaggtgaggccgcaaaggccattaaggatgggttccctcatgtgaagtgtagtgttatggatttggcgcatatcatagagaatgtgccccgtaagcctgacctggattttgtgagcggagatatgtttgcatctgtgcctaatgctgatgtagtttttgccaagtctgttcttcacaactacgaagacgtagattgcctcaaaatcttaatcaagtgcaaggaagcattaccttcactaggaggaaaactggtcttggttgagatagtacttgatgcagaaaatttaccagagttggcttttgcaagactggggatggacatggaaatgatttgcatgggtggaaaagaaagaaccaaacaagaatggggtgatatattacacaaagctgggtttagtcatcataagatcataccaatcatggctattgaatccatcattgtagcctatccataa

SEQ ID NO: 604 - DNA, 1038 bp, Berberis thunbergii
atggacaccttgaatggctacacagatcattttgaagacgatgaagacatcagtgcacaagctctagtatggaaccatatgtatggtttcgcgaatacaatcatgttacggtgcacccttcgtcttaatcttcccgacataattcacaaggaaggaccactgacgttgtctcagttagcgagtaagctgcctttcaattctatcaatctcgatcgattcaaccacatcatgaggtacttagtacacatgaaactctttaagatcgtcaataaagacaagtatgctctaacccgagcatcggagcttcttgtgaaatctcacgaaaagagcttggccccgttcgcgatgttgcaaactcatccccaagagttcactgtctggggacattttatcgaaaatcttgataaggccaagaactacactgaagtgtaccatgaaatggacaatgatcctgagatcaataagctggtcaatgaggccatgactagccataccaagtgtatggtgccggccctcgtttctggcttgaccaaggagaatgtcttggctgatgtcaaatcgcttatcgatgttggagggagtgaaggtattgcatcaaaggcaatcatcgatgttgtttcacatgtcaagtgtattattatggatttggctcatgttatcgacactgtgcctaaggaccccagactggatttcttggctggtgacatgtttgattttgtccccaaagctgatgcagttatgctcaagtctattctccacaactatgatgatgacaactgcctcaagatcttaaccaagtgcaaggaagctatacctacaaaaggaggaaaggtggtaatagtagaaattgtaattgacacacagaatttgccagagttctcttctgcaagattggggttggacatggagatgatttgcatgggaggacaagaaaggaccaaacaagaatgggcaactctcttgcacaaagctggatttgatcatcataccatcattcctataagggctattgaatctattatcgtggcttgcccttag

SEQ ID NO: 605 - DNA, 1092 bp, Berberis thunbergii
atggccttcactcacaatggcctagctactcaagagagtcctagctatctctcaggtttaggcctatcacgcttaatctgccttccaatggcactaagagcagcaatcgagctcaacgtgttcgaaatcatttcccaagctggtccaaaagcgcaactttcttcatcacaaatcctcacaaaaatccccacaaagaaccccaatggagcgatagccttagagcgcattcttagattgttgggtgcaagttcaatcctctcagtctccacaaactcatcaaaccaaagagtttatggcctaacaagtgagtcccgtacattggtgcccagagctgaccaagtttctgtggtgcctatgttgctcttcacagctgataaggctgttgttgagagcttttacatgcttaaggatgtcgtcctcgacgaaccagggtgtataccatttgataagactcatgggatgaatttttttgagtatgctgggaaggagcctagagtgaacaaagtgtttaatcaagctatggctgttgggtctactattgcttttgatgaagtctttaaggtgtacaataaagggtttgatgggatgaaagagttggttgatgttggaggtggaattggaacctcccttagtagtattgtggctaagtatccacatattaggggtattaactttgagttggatcatgttattgctgatgcacctgcttatcccggtgtggaacatattgcaggaaatatgtttgaaggggtaccaagtgcccaaaacattatgctcaagtgggtacttcatgactggggcgatgagcaaggccttattatactaaaaaactgttggaaggcactgccagagaatggaaaggtgattgtaattgagtttgttcttcctgaagttttgggaaacaatgctgaatccttcaatgcattgacgcctgatctgcttatgatggcgttgaaccctggtggtaaagagagaactattgctgaattcagtgggcttgcaaaggaagctgggtttgaagaagtgaagcctttcccaatctcacagggtctccatgtaattgaattccacaaaacaaaagcttgtgcttaa

SEQ ID NO: 606 - DNA, 1092 bp, Berberis thunbergii
atgggttcaaccacccacaccccaatcaaaatcacagctcaagaggaagatgaagcttgcagccatgcgatgcaattggcaagtgcttcagtcctccctatggtcttgaaagcagcaattgagcttgatgtgcttgaaatcattgctaaagctggtcctggtgcctacatcagccctgctgaaattgtatcacaactctccactactaacccagaggcccctgtcatgcttgatcgtatgttgcgtctccttgctagttacaaggtggtgacttgcactctcaaaacttctgagggtggagaagttgagaggttgtatggtttggcccctgtgtgcaaattcttggtcaagaatgaagatggtgtctcaattgctcctttggttctcatgaatcaagataaggtcctcatggaaagctggtaccacttgaaagatacagttttagatggtggcattccattcaacaaggcatatggaatgacagcatttgagtaccatggcacagaccctaggttcaacaaggtcttcaacaggggaatggctgatcactcaaccataaccatgaaaaagattctcgaggtttacactggattcgatggtttgaaatcattagtcgatgttgggggtggtactggtgctataattaacactattgtttctaaatacccatcgattaaaggcattaactttgatttgcctcatgttatcgaagatgcaccatcatatcctggtgttgagcatgttgggggagatatgtttgtcagtgtcccaaaagcagatgccatatttatgaagtggattcttcatgactggagcgatgagcatagcttgaagtttttgcaaaattgttacaatgcattgccatcagatggaaaggtgattatcgcagaatcaattcttccagtgttaccagagacagatctcgccgcaaatggtgttttccagcttgacaacatcatgttagctcataatccaggaggcaaagagaggacagaaaaagattttgaaggcttggcaaagaaggccggattttctggtttcaaagttgtatgtcgtgcttatggcacttacatcatggagttctctaaatag

SEQ ID NO: 607 - DNA, 1086 bp, Berberis thunbergii
atggctttaatccaaaaccaagttagagcagctggtgatgaggaagctgattgtttgttcgccatgcaattggcgagctcatcagtcttgcctatggtactaagagcagctgttgagctaaatgtgcttgagatcatagctaaagcaggggtgggtgcacagttatctgcaaaagaagttgccagtcacattacaagccaaaactctgatgctcctgttatgcttgatcgaattcttcaccttcttgctagtcactctgtgcttacttgctctggtgtcacgcgtgaggatggcacggttgagagactttatggtcttgctccagtgtgcaaatatttggttcgtaatgcggatggagtttcctttgctccactgttgatgtctactcaagataaagtcttcatggatagttggtatcacttgaaagatacagttgtcgaaggaggaataccattcaacagggttcatggagtacatgcatttgaataccctggcattgatcccagattcaatgagattttcaaccaagcaatgtttggtcatactacaataatcatgaagaaaatgctcgaaacatacaagggatttgagaatctcaaagaggttgtcgacgtgggaggtggacttggaactacacttaagatcatcacttcgaagtatcccacgattaagggtattaacttcgatttaccccatgttatcaaacatgcaccatcttctcctggtgttgaacatgttggtggagatatgtttgcaagtgttcccaagggtgaagtaattttcatgaagtggattcttcatgattggagtgatgaacaatgtatagttcttttaaagaactgttacaaagcattgcctgagcatgggaagttaatcatcgtcgagggcattcttcctgaagttccagagacaagtgttgcgaaccaaggcctctgtcaaatagacctggtcatgttagctcaaaacccaggaggaaaagaacggactgagaaagagttccgaactttggcaaacttatctggttttgcaggtgtttacaaagtgtgttgtacttgtaattattgggtgatggagtttttcaagtag

SEQ ID NO: 608 - DNA, 1128 bp, Berberis thunbergii
atgtctccaaaccaaaaccaccaaaacaccaccgtggcttaccccccaaaccatcaaaacccccacaccgccaccaatgaagataatgagagcttcttgttagccatgcaagtagtgaacacactgacctttccaatggtcatgcaggccatcattgaacttgatgtgttggagatcatagcaagggaaggtcaaggtgctcaactctctccatcacagattgcatctcatcttcctactaaaaaccccgaggcaccgatgatgctggatcgaatgatgagactcttagcttgccacaatatgcttacatgctctgttgtcactctcaagagtggcaaggctgaaaggatgtatgggttgactcctctttgcaagttctttatcaaggatggaaatgggatctctttggctcccttcatcaaatggatgcatcacaaggacttgatgcagagttggtaccacttgaaagatgcagtacttgaaggtggtgttccttttgacatggcttatggaatggatgtatttcaatacttcggggagaaagctgaattgcatgagctcttcaacaggatgcaattcattcatacaactactgtcacaaacaagatcttggagacatataaagggtttcatggcctgaaagaagtggttgatgttggtggaggacttggggtcatgattgatggtataactacaaagtatcctacaattcaagggattaacttcgatttgccacaggtcattgagcatgcgccacgctatcagggagttgaacacattggaggagatatgttcatttccattcccaaaggagagactatctttatgaagtttgttctacatgattggaacgatgagcaatgtctaatactattgaagaattgttacaaagctcttccgaatcatggaaaggtgatagtagtagagataattgccccagtgatccccaaagacgatgcttcttccagagtgtcttgtcaagaggatattatcatgatggctcaagcccctggtgggaaggaaagaacagagaaggagtttgaggctttggcattgggagctggatttgttggtgtcaaattggtgtgttctgcttgttactactgggtaatggagtttcataaataa

SEQ ID NO: 609 - DNA, 1050 bp, Corydalis chelanthifolia
atgggtgtcaatgatatagctgaagttcaggatgttgacctcaaagctcaagctcatctatggaacataatctatggattcgccgattcgctcgtccttcgttgcgcagttgagctcggaatagcagacattatcaatagcaacaatgggccagtcacaatctctgaaatcgcatcgaaactcccggttgacaatgttaataccgataacttatatcgggttttacgttatttagtctacatgggtctcttgaaagagtcccaaaataagtgttactcattagaaccagttgctactttgctcttgaaagatgctcagagaagtatggttcctatcattctaggaatgactcaaaaggatttcatggttccttggtttttcatgaaagaaggattgggtagtgggagtagtactgcatttgagaaaggtatgggaatgactctttgggagtatttggaaggacacccagatcagagtcaattgtttaatgaaggaatggctggtgaaactagatttttgacttcttcgcttatcaatggttgtcgtgacactttcgaaggtttaacttctcttgttgatgttggaggaggaaatggtacaaccattaaaggtattcatgatgcatttccccatattaaatgctctgtctatgatcttcctcatgtcattgctaatgctcatcctcaccccaacatcgaacgaatccctggagacatgttcaagtctgttccaagtgcacaggcaattttactcaagctgatcttgcacgactggactgacgaagaaagtgtgaacattctaaagagatgcagagaagcagtacctaaagaaggaggaaaagtgattatcgttgatgtagcactggaggagggatctcaacatgagcttacgaagacgagattgatacttgatattgatatgttggtgaacacaggtggaagagaaaggagtgtggatgattgggacagaatgctcaaacttgcagggtttagtagtcacaagatcaggcacattgcagccattcaatctgtcattgaagccttcccatag

SEQ ID NO: 610 - DNA, 1044 bp, Corydalis chelanthifolia
atggaagtgatcaagaagagtgatcaagcagatcaagccaaactctggaagttcatctatggatttgccgattcactagttcttaaatgcgcggtcgagctagaaatagccgatacgattcataagcacggggaaccgatgacgctttccgaattagctactaaacttcctaaacaacccatcgatacggaccgtctatatcgaataatgaggtacttggttcaaatgaagttgtttacaaaagagacttctcaatccggggaagtcaaatatgggcttttacccccagcaaaatttgtggtaagaggatggcagaattccatggttggttcattgctagcaatcaatgataaggatttcattgcaccttggcattatctcaaggatggtttgggtggcgaatgtgatgctttcgagaaggcattaggaaagaaaatttgggattatatgtccgaaaaccccgaaaagaatcaacttttcaatgaggctatggcttgtgatactaggcatatccttatttcggcgttgattaaagattgtaaggatgttttcaaaggaattaagacacttgttgatgttggtggtggcaccggaaccgcggtgaaagcgatttctgatgcttttccggatataaaatgcgcggtttatgatcttcctcatgtgattgcggattctcctgttgctcctaatatcgatcgaatcgaaggcgatatgttcaagtccatcccaaatgcagatgccatctttatgaagtgcatcctccatgattggaacgacgacgaatgcattcaaatacttaagcaatgcaaaaaagcgctacaagacggaggtaaagtaatcatcgtagacgtggtgttgaatgtggattcgaaacatccttacacaaaaatgagattgactttggatttggacatgatgctcaacactggagggaaagagagaacagaggaggaatggaaagaactgtttgaagctgcaggtttcagtggatacaaaatcattcaaatatcagctctacaatccgtgattgaggcttatccttaa

SEQ ID NO: 611 - DNA, 1047 bp, Corydalis chelanthifolia
atgaatatgagtgagttatcccttgaaaatgatgccaaaatctggaaatacatctatggatttggtgatacattagtcctaaaatgttgtgtagaccttggaatagccgatacaattcataagcatggccaaccgatgacactttccgaattagcttctcaactttctaatgatcagcaacaaaccatcgatacagaccgtctatatcgattgatgcggtatctggttcaattgaaattgtttacaacagagggatctcagttaggggaaatcaagtatgggcttttgccaccggcgaaattcttaataagaggatggcagaagtccatgggtggtatggtatcacttattgatgaggatttcattgctccttggtatcatctcaaggatggtttggatggtcacactgaccctttccaaatggcgtttgggaagaaactctttgattatttgtccgaaaaccttgaaaggagtcagcttttcaatgagtatatggctattgatagtaagctccttactttggagttggttaattgtaagaatgttttcgaagggattaaaacacttgttgatgttggtggtggcaccggaacaacggtgagagcgattgccgatgctttcccacatataaaatgcatggtttatgatcttcctcatgtgaatgcggattctcctgttgatcctgatatcgaacgaatcgatggagatattttcaagtccgttccgaaggcagatgccattttaatgaagtggatcctccacgattggaatgacaacgaatgtattcaaatattaaagcattgcaaagaatcaataccccaagatggagggaaagtaatcatcattgacgtcgtggtgaatgtgaattcgaatcatccttacacaaaagttagattatattcggatttggatatgatgatcaacactggaggaaaggagagaactgaggaggaatggaagaatctactcgaagcggctggtttcactggatacatacacactgaaatatcagcggtacaatccataattgaagcttatccttattaa

SEQ ID NO: 612 - DNA, 1104 bp, Corydalis chelanthifolia
atgggttcaactgagaatgaaatcaagaccagtgctactactaccaaagaagaagaagaagaagaagcatgtttgtatgctatgcaattagcaagtgcttcagttcttcctatgatactcaaatcagccatagaacttgatttgcttgaaatcatggctaaatctggtgtgggtgcctatataagtccatctgagcttgcttctcagcttcctaccacaaacccagctgcatctactatgcttgatcgtatgttgcgtctcttggccggttacaaggttctcacgtgtaaacttaacacgcttgatgacggtcgggtcgaaaggttatatgggcttgcacctgtttgcaagtacttgattaagaatgaagatggtgtgtccatggctcctttggtcctcatgaatcaagacaaagtcctcatggagagctggtactacttgaaggatacagttcttgaaggtggaattccattcaacaaagcttatggaatgccggcattcgaataccacggtacagatcccagattcaacaaggttttcaacaaaggaatgtcggatcacactaccatttcaatgaagaaaattctcgagacatacaagggattcgaaggtttgaattccatcgtagatgttggtggtggtaccggtgcaacagttagtatgatcgtctctaagtacccgtctattaaagggattaactttgacttgcctcacgtcatcgaagttgcaccggcttatcccggtgttgagcatgttggaggagacatgtttgctagtgttccaaaaggagatgccattttcatgaagtggattcttcatgactggagtgatgaacacaaccttaaaactttgaagaactgttacgaagcgttgcctgccgatggtaaagtgatcattgtggaatcaattcttcctgtattccctgaaactaagtctgcagctgttggtgttttccatgtcgatgtcatcatgttggcacacaaccctggtggaaaagaaagaaccgagaaagagttcgaggccttagcaaaggaagctggattttccggttttaaagttgtttgctgtgcttttaacagttggatcatggaattctgtaaatag

SEQ ID NO: 613 - DNA, 1071 bp, Corydalis chelanthifolia
atggagatgacaatcaatggaggagacaaagaacaagagatgaaatgtcagggtcaagtttggaaccacatttgtggtattgttgattcattggttctcaagacaacacttgaactgagcatctttgatacagttcacacccacacaaattccactatcactttctctcagctttcaaaatctccatccttggcttccatcaaacccaagaatttgtatagattgctaagatacttagttcacttgaatcttttaacaatcaaggttgttgaaggagaagaaacattttcattgacaaatttgtccatgttactacttgaaaaccaagagaaaagtttaagggattggtcacttgggatcgacgatccaacctcgataaacatatggcatgaattgagtaaatttgttactgatccggctgatgcaccgacgccttttgtgcagattcatggaaagactctatgggaattagctggggagattcctgaagtgaacacacttattaacaatgctatggcctgtgatacaaggttggttatgcctgcagttgttcaaggatgtcaggagcttttgaatggaatttcgtcgttggttgatatcgggggtggaaccggtgcagctatgacttatgttgctaaggcttatccccatgtgaagtgcaagtctttcgatctacctcatgtcgtagctgaagcaccggcatttcccggtgtggaattgattggtggtgatatgtttgagttcatcccccctgcagatgctatttcattgaagttcatgcttcacaattggcaggacgaagcgtgcataaaactactgaagagatgcaaagaagtcattccggcagacaacgggaaggtgatcataatagacatagtgttggatcaagatgaagatgatgatgagctaacaaaagctagagtaagtctcgatatcgatatgttgttgagctcaggaggcaaagaaagaaccaaggatgaatggagagtactagttgaaaaggctggttatagcagggttgagatcatccccatttttgctatacaatcagttattgttgcatatccttag

SEQ ID NO: 614 - DNA, 1032 bp, Corydalis chelanthifolia
atgcaattggcaagtgcatccgttttaccaatggtgttgaaatctgctatcgagcttgatctgctcgagactattgccaaagccggtcctggtgcttatgtctccccgacagagctcgcggctcagctaccaaagtcagacaatcctgaggcacccgtcatgctagaccggatctgtagactattagctagttacaaggtactcacttgtacccttaagaacaaagatgatgatggtcatgttgttgaacgactctatggtcttgcacccgtttgcaagttcttggtaaagaacgaagacggtgtttctgttgcacctctgttgctcatgaatcaggataagattcttatggagagctggtaccatttaaaagattcagtattagatggtggaataccattcaacaaagcgtatgggatgtctgcttttgagtatcatggtaaagatcaaagattcaacaaggtgttcaacagtggtatgtttgatcactccaagatgaccatgaaaaagattcttgatatctatgatggttttaatggcctcaccaccctcgtggatgttggtggtggtactggtgccagtctcagcatgattgtctctaaacacccttcaatcaagggtattaattttgatttgccacatgtcatcgaggatgccactacttatcctggtattcagcatgttggtggagacatgtttgaaagcgtgccaaagggagatgccattttcatgaagtggatctgtcatgactggagtgatgaacattgcgtgaaatttttgaagaactgctacaaggcactcccagagaacgggaaagtcatagttgctgaatgcattcttccagaggcacctgactcgagcctagccactcaaaacgtgatacacatagacgtcatcatgttggctcacaaccctggaggcaaagagaggaccgagaaggactttgaggcattggcaaagggggcaggttttaagggtttccgcaaggctgcttgtgctctcaatacttgggttatggaattttgcaaatag

SEQ ID NO: 615 - DNA, 1026 bp, Corydalis chelanthifolia
atgcaattggcaactgcatctgtcttacctatggtactgaaaaccgccatcgagcttgatttgcttgagatcattgccaaagctggccctggtggttcagtctcttcttcagagctggcggctcaactccctttggttaacaacccagaagcaccagtgatgctagacaggatctgtagtctcctggctagccattctgtgctcacttgtaaactcaaggagaccagtgatggttgtgctacgcagttctatggtttagcccctgtttgcaagttcttgatcaagaacgaaagtggtgtttctttggcacccttattgctcatgaaccaggataaggttctcatggagagctggtactatctaaaagatgcagtttttgatggtggggttcctttcaacaaggcttatggtatttcagcttttgagtaccatggaaaagatccaagattcaataaggttttcaatagtggaatgtttgatcattcaaccatgagcatgaaaaagattgtggatttatatgatggtttcgagggtgtccagaccctagtcgatgttggtggtggcataggtgcaagcctcaacatgatcatctctaaacacacttcactcaagggtatcaattttgatttgcctcatgttattgaacacactgcaacttatcctggaattgagcatgttggaggagatatgtttaatagcgtaccaaaaggagatgccatttttatgaagtggatactacatgactggggtgatgcacactgcctcgaacttttgaagaattgctacaaatcacttccagatggtgggaaagtgattgtggctgaatgcattcttccagaagttctagactctactaaattgacacaaagtgtgaggcaaattgatatgattatgttggctcacggtgtgggaggaaaagagaggaccgagaaagaatttgaggccttagccaaaggggcaggtttcaaaggttttcgcaaggctatttgtgctctcaatgtttgggttatggaatttttcaaatag

SEQ ID NO: 616 - DNA, 1059 bp, Chelidonium majus
atgggtgtgaatgatatggcagtatctcaagaggttgacatcaaagctcaagctcatctctggaacatcatctatggctttgctgattctctagtcctccgttgtgcagtagagattggaattgcagatatcatcaagaacaacaatgggtcaatctctgtttctgaactctcatcaaagctcccaatctcaaacgtcaattctgataacctctaccgtgtcctaagatacttggtacacatgggtatcttgaaagaagattcagacattaatggtgtcaagctttactcactccaaccagtagctactctgcttttaagagatgcagagaggagcatggtacccatcattttagggatgacccaaaaggatttcatggttccatggcattttatgaaagaagggttaggagatggaagcactgcatttgagaaagggatggggatgaccatttggcagtacttggaaggtcatccagaacagagccagttgttcaatgaagggatggctggggaaactaggttactgactaaatcacttattgagggttgtagagatacatttgaaggtttgacatctcttgttgatgttggaggaggaaatggcacaacaattaaaggaatttatgatgcatttccacagatcaaatgctctgtttatgatcttcctcatgttattgctagctctcctgagcacccaaatattgaaagaattcctggtgatatgttcaaatctgttcctagtgctcaagctatcttactcaagttgatcttgcacgattggactgatgacgagtgtgtcaacattctaacaaagtgtagggaagcagtaccaaaagagacagggagagtgatcatagtagatgttgcacttgaagaagagtcccaacatgaactcacaaagacaagattgatactagatattgatatgttggtgaacactggtggtagagagagaactgaagatgattgggaaaagttgctcaaacgtgccggctttagaggtcataagatcaggcacattgcagctattcaatctgttattgaagccttcccatag

SEQ ID NO: 617 - DNA, 1071 bp, Chelidonium majus
atgggaagtagcagtatagatgtgaaaccagctgaaacacaagaagttagcatcaaagatcaagctcaattatggaatatgatctacggttttgctgattctcttgttgttcgttgcgcagtagagcttggcattccagatattatcaaaaacaataacgggccaatcacacttgcacaactttcatcaaaactcccaattccgaatgtcaactcggatcacttgtacagaattgtaagatatttaataaacctgaatatcttacaacaagaaatttgtcgtaatgttaaggtctactcacttaaaccagttggtactttacttttaagagatgcagaaagaagtatggtgccaatattattaggcaatacacagaaagatttcttggttccatggcatttcgtgaaagaaggtttagtaaatggaagtacaacagcatttgagaaaggaatgggtatggatatatggaagtatttagaaggtaatccagatcaaagtcagttgtttaacgaaggaatggctggagaaacaagtcttttaactaaaactctaatcgaagattgcagagatactttccaaaatttggattctctagtcgatattggtggaggaaatggtacaacaattaaggcaatctatgaagcttttcctcatatcaaatgtacgctttatgatctaccacatgttgttgccaactctcatgatctccctaaaatcgaaaaagttcccggtgatatgttcaagtctgttcccagtgctcaggctatcttactcaagttgattttgcatgactggactgatgaagagtgtgtcaacatcctaaagaagtgcaaagaagcaataccgaaagagacagggaaagtgattatagtggatgtagcacttgaagaagaatccaaccatgaacttacaaagacaagattgattcttgatattgacatgttggtaaatactggtggtagagagagaactgcagatgattgggaaaatttgctcaaacgtgcaggctttcggtctcataggataagacccattcgcgcaattcagtctgtcatcgaagccttcccttag

SEQ ID NO: 618 - DNA, 1065 bp, Chelidonium majus
atgggtagtagtatagatgctgaaacacaagaagttggcatcaaagatcaagctcaaatatgggatataatctatggttatgctgattctcttgttcttcgttgcacagtagagattggaatcgcagatattatcaaaaacaataatgggtcaatcacactttcagagcttgtatcgaaactaccactttcaaatgtgaattctgataatttgtacagaattctaagatacttagtacacctgaatatcttaggacaacaaacatgtgctgctggaggtgatagggtttactcacttaaaccagttggtactttattattaaaagattcagaaacaagtatggtaccagtaatattaggtctgtcacaaaaagatttcttgtttgtatggaatttcgtgaaagaaggtctaggcactggaagtacaacagcatttgagaaagcaacgggaatggatatgtggaagtatttagaagttactcctgatcaaagtaagttgtttgatgaaggacaagctggagaaacaagacttttaactaaaactctacttgaagattgtagagatacttttcaaggtatggattcgcttgttgatgttggtggaggaaacggtacgacaattaaggcaatccatgaagcttttcctcatattaaatgtacgctttatgatcttcctcatgttattgcaaactctgatgatcaccctaacatccgaaaagttcccggtgatatgttcatgtctgttccaagtgctcaagttctcttactcaagtgcgtcttgcatgactggactgatgaacactgcgtcaacattctaaagaagtgcaaagaagcaataccaaaagagacagggaaagtgatcatagtggatgtcgcacttgaagaagaatccgaacatgaacttacaaaggcaagattgattctcgatattgatatgttggtgaatacaggtggtagagagagaactgaagatgattgggaagatttgctcaaacgtgcaggctttcggtctcataaaatcagaccgattcgcgctattcagtctgtcattgaagctttcccatag

SEQ ID NO: 619 - DNA, 1047 bp, Chelidonium majus
atggaagcaaccaagattgatcaagcaaaccaagccaaaatctggaaactcatctatggttttgcagaatccctagtcctcaaatgtgccatccaactcgaaatcgccgagacaattcacaaccatggaaaacccatgaccctatccgagttagcttctaaattacctgttcaaccagtcaactccgaccgattataccgagtcatgcgttacttagtccacatgaagctcttcaacaaagaagagacctccattaatggagaattcaaatactccttagccccacctgctaaattcttgataaggggttgggagaaatcaatggtagcttcaattctagcaatcaatgataaggatttcttggctccatggcatcatttgaaggatggattaagtgggaattgtgatgcttttgagaaagctcttgggaaaagcatctgggtttatatgagtgagaatcccgagaagaatcagctttttaatgaagcaatggcttgtgatactagattagttacatcagctttggtgaatgattgtcaaagtattttccaaggaattaaaactctagtggatgttggtggtggaactggaactgcagtcaaagctatttctaaggctttccctcacatcaaatgcactatttatgatcttcctcatgttattgctgattcccctgagattccaaatgttgttaaaattgaaggggatatgttcaagtctgtaccaaatgctgatgccatcctaatgaagtgtattcttcacgattggaatgacgacgagtgcattcaaattctaaagaaatgcaaagaggcagtaccacaacaagggggtaaggttatcattgtcgacgtcgtactaaacatggacttgtcacatccttattccaagattaggctaacattggatttggacatgatgcttaacactggaggaaaagagagaacagtggaagaatggaagaagctcattgatgctgcagggtttgcaagttacaaaattactcaaatttctgcagtacaatctgtaattgaggcttatccttattaa

SEQ ID NO: 620 - DNA, 1095 bp, Chelidonium majus
atggattctagtagtactcaagaaatgaatgatacagagttgatgcaagctagggctcatatttttaaccatgtatgcagctttataagttccatgtctctcaaatgtgcgattcagttagacataccagacatcatccacaaccatggcaaacccatcaccctctccagcctcgttgacgttctctctctaccaccgtcgaaatcccatgctctgtatcgtctcatgcgcctcttggttcattcaggattctttgctagacaaaaaatcgatcaaaatcaagaagaggggtatgtgctcacaccatcttcaaggctcttagtgaaagaggttaataacaagtactccctctcatcttatgtgaccaatctgctagatccttccctgctaaaaccttgtcatttcttaagtgattggttcaaagggagtgggtcaacagcattcgaggctgcttatggtgtgcctttctggagtttcatgcaggaacactttgaatatggcaagatctttaatgaagccatggccgttgattctcggttggtattgagtgtaactgtcaatgactgcagtgcagtttttgagaatttgagctctttggtggatgtaggaggtggcaccggaactgcagctcaagtcatttctgaagcatttccacacttgagatgtgtggttcttgacctcccacatgtggttgcagatcaattaccaaagagtattaataagaacttagatttcatcgctggtgacatgtttgagtccataccgtctgccaatgcagttttattgaagaatgttttgcatgattggggcgatagtgactgcataaagatactgaagagatgcagagaagccattccatccagagaggagggaggaaaggtgattataatggatattgcggtggaagacaggaaagaagaacatgccactactgaaacgcaactatactatgacatgtttatgctgactatgtatactactggtaaagagagaactgagaaagaatgggagaagctcttcttggagtcaggttttagtgactataagataactcctcttaaggggtttagctccctcattgaggtttttccctag

SEQ ID NO: 621 - DNA, 1074 bp, Chelidonium majus
atggaagtagttagccagattgatcaagaaaatcaagcaataatctggaaacaaatttatggtttttcggaatcattacttctcaaatgtgcagttcaatgtgagattgctgaaactattcataaccatggaacaccaatgtctatattggaattagctgctaagcttccaattgatcaaccggttaatatcgagcgtttgtaccgtgtgatgcgttacttagttcaccagaaacttttcaacaaggaagttatcaccacgcttaatggtggaaccgttcaagtaacagagaaatactggttagctccaccggcgaaatacctaataagagggtctcaacaatcaatggttccttcagttttaggaataattgatgaagatatgtttgctccgtggcatattctaaaagacagtttaactggtgaatgtaacatttttgagaaagcgttaggaaaaagcatttcggtttatatgagcgaaaatcctgaaatgaatcaaatttccaacggagcaatggcttttgatagtggattagttacttcccatttggttaatgaatgcaaaaatattttcggtgatgaaattaaaacactagttgatgttggtggtggtactggtactgcaatcacagcaatttccaaagcgttccccaatattaagtgcacactctttgatcttcctcatgttatagctgattcacctgaaattccaactattacaaaagtttcgggagacatgttcaagtctattccaagggctgatgccatattcatgaagaacatccttcacgattggaacgatgatgaatgcattcaaattctaaagcgatgcaaagatgtagtatcagcgggagggaaacttattattgttgaaatggtattggacgaggattcgtttcatccatattcaaaacttagactcacatccgatatagatatgatggttaacaatggaggtaaagagagaaccgaaaaagattgggaaaagctttttgatgcagcaggttttgctagttgcaaatttactcaaatgtcagtaggtttcgcagctcaatctataattgaggtttattga

SEQ ID NO: 622 - DNA, 1062 bp, Chelidonium majus
atggaaatccaattaggagatcaagaacaagaaatgaaatatcagggcaaagtttggaaccacatttgtggtagtgttgattcagctgttctcaaatgtacaattgaattaggtctccttgatacaattcacagttcatcaaaacccataaccctttctgatttatcaacttctccatctttatcttctctcaaaacccagaacttgtatcgattattaagatacttaactcatatgaacctcataaccatcaattctactgaaggaattgaaacattttcattaacagacttatctaaattactccttaaaacccaagagagaagtttgaaggattgggtacttgggatcgacgacgaacactcgattactagttggcatgagttgagtagttattgttgttcgccggacgatgcgccaacgccttttgtgaagttgcatgggaagactctttgggaattagctgaggaagttcctgaagtgaatgaacttattaacaatggaatggcttgtgatactaggatggtcatgccagcctttgtacaaggttgtgagaagattttgaatggaattacaaaattggttgatatcggcggaggtaccggtgccgccatcagttatgttgttaaggcttttcctcatataaagggtacagttttcgatctacctcatgttgtagcgacggcaccggagatccccggagtggaaatggttggtggtgacatgtttgaatccatccctcctgctgatgctcttctactgaagttcatgctccataactggaaagacgacgaatgcataaagctattgaagagatgcaagggagcaattccaacagaccaagggaaggtaataatcattgaaatggtgttggatcaagatgaggacgatgacgatctaacacaagcgaggttaagtctcgatctcgatatgatgttgagttcaggaggcaaagagaggactaaggatgaatggagagtactacttgagacagctggtttcagcaggattgaattcattcctatttttgccatacaatcagttattgttgcatatccttag

SEQ ID NO: 623 - DNA, 1341 bp, Chelidonium majus
atgaaagatatgtttagaattagagagaagagaggagagagagagagaggagagagagggaaccaagtcatcaacaactatgttcaagatgaaggagtggtggggtcctttagaaacttggtggttgaattcatcaccacatatatattcccctcctctcccaccatggttcatcatcattacctagctattaaactcttcttcttcttctatcaatatcaaattaaccctagaattgaagaaatgggttcaacccaaaaccaattcaacgccacaacagatgaagatgaagaagcccaagcttgcatgtatgccatgcaattagccagtgctactgtaccagtcatggttctaaaaacagctgttgaacttgaccttcttgaaatcatcaagaaagctggtcccggtgcgcaaatcagttgcactgaaatttcatctcagatccctaacaacaagaaccctgatgcccctgttatgcttgatcgtatgctccgactcttggcaagttacaaaattctcacttgctctttgagagatcttgaagatgggaaagttgagaggctttatggacttgcacctgtctgtaaattcttgactaagaatgaagttggatgttcaatggctcctctgcttctcatgaatcaagataaggtccttatggagagctggtaccatatgaaagatgcagttattgatggtggaatcccatttaacaaggcctatggtatgtcagcattcgagtaccacggcaccgatcttcgattcagcaaggtatttaacaagggaatgtctgatcacacaaccatagtcatgaacaaaatcctcggaacatacaagggtttcgaaggtttgaaatcaatcgtagatgtcggaggaggtgtcggtgccaccgtgaatatgattgtctccaagtacccaacaatcaaaggtattaacttcgacttaccttacgttgtcgaagaagcaccatcttattcgggtgtggaacacgtcggtggtgacatgtttgttagtgttccgaaaggagatgcaatcttcatgaaatggattcttcatgactggagtgatgaacacagtgtgaaaattttgaagaactgttatgaagctttgcctgaaaatgggaaggtgatcattgttgaatgcatcattcctgtgatccctgatggtgcttcaggtcatggtgtgtttcatctagacaacattatgttagctcataaccctggaggtaaagagagatcagaaaaggaatttgaagctttggctaaagggacaggatttacaggttttaaagtggtatgttctgcttttgatacccatgttatggagttctctaagaactaa

SEQ ID NO: 624 - DNA, 1104 bp, Chelidonium majus
atgggttcgatcgaaaaccaattcaaaaccaaccctatagaggtagaagaagaagcatgcatgtatgcaatgcaattagcgagcgcttcggtacccgtcatggtattaaaagcagtggtagaactcgatgtgctcgaaatcatagcgaaagctggtccgggtgcacaaattagtgtggccgatatcgtgtctcagatcccaaatgtcaagaatcccaacgcacctgtaatgcttgatcgtatgttgagactgttggctagttacaagatcttgacgtgctctgtgaaggaccttgatggccagggtctagtccagcaaagactctatggtcttgcactagtctgtaaattccttgttaagaatgaagatggttgctcaatggctcctttacttttaatgaatcaagataaggtcttcttgggaagctgggaccacttaaaagatgcagttgttgatggtggaatcccatttaacaaggcctatggtatgaacgcatttgagtaccaaggtgctgatcctaggttcaacaagatctttaacagagcaatgtctgatcacgccaccataaccatgaagaaaatcctagagacctacaaaggttttgaaggattgaacaccctcgtagacgttggtggagggattggtgtcaccatcgacatgatcgtttccaagtacccatcaatcaagggaaccaatttcgacttacctcacgtgatcaaagacgcaccgtcttatccgggtgtcgaacatgtcgggggagacatgtttgttagtgttccaaaaggagatgccatattcatgaaatggattcttcatgattggagtgatgaacatagtgttaaaatcttgaagaattgctatgaagccttgcctgagcatggaaaagtgatcctatttgaatgcattattcctgcgtaccctgaaactagccttgcaagtcttggtgtgtttcatgtagacaacattatgttggctcataaccctggaggtaaagagaggagtgagaaagaatttgaagccttggctaaaggtactggttttgctggttttcgagtcatctgttctgcgtacaacacttggattatggagttatctaaaaactaa

SEQ ID NO: 625 - DNA, 1110 bp, Cissampelos mucronata
atgacagtgctggaggggctaaccatctctgtcctctgcactcccattacttcatttggtaagaataccatggaagaagccatggatgtccatgagcaagcacacctgtggaagctcatctacggcttcgtcgacaccttagtagtaaggtcggcggtggagctcggaatcttcgacatcatcaacaacaatttgaagcccatgacagtgctggacttggcctcaaagctccccatctccaacccctgttcggatcggttgtatcgaattcttcgatacctagttcatgtccgccttctcaaggtgaccgatatcgatggcctcaagcgctactcgatccaacccgtcgcgaggttcctactaagggactacgacaagagcatggcgcctatcattctgggcatgactaagaaggagttcatgtcttcatggcaccacattaaggatggattgagcgacgacgggagcaccgccttcgacaaggccatggggatgagcttcttcgagtacttggaggagaaccccagccagagcaagctcttcaatgaggccatggcgggggagactaggcttctcactgcttccctcatcaatgactgcaaagacatctttcaaggaattgagtccctggttgatatagggggaggaaatggcaccaccattaaggccatttccgatgcgtttccgcacatcagttgcgccctcttcgacctccctcatgtcgtcgctgactccaacgatgatcacccgaatattaaacgcgtcgctggagacatgttcgagtccatccctacctcccaagccatcttgctcaagttgattttgcacgattggagcgacgaagattgcgttcggattctaaagcgatgcagggaggcggtgccgaaggaaggggggaaggtgatcatagtggatgtggcattagaagaggagtccaagcatgagctgaacaatccaaggttggttttagacattgatatgttggtgaacactggagggaaagagaggagcagagaggattgggagaagctcaccaaactagcagggtttggagggtacaagattaggcacattgctgctatacaatcagtcattgaaatcactccttaa

SEQ ID NO: 626 - DNA, 1032 bp, Cissampelos mucronata
atggaagaggaaatgaaagcacaagcccaggtgtggcgctacgtgtacggcttcgccgactccctcaccctcaagtgcgccatccagctggacatccccgacatcctccaccggcacggccgccccctctccctctccgccctcgcctcccgcctccccctccccaccgtcaaccccgaccgcctccaccgcctcatgcgctacctcgtccacatgggcctcttcgacctggtcccttcccccgacgagcccgcctacgcctccaacccttcctccgccctcctcgtcaagggccagcccaagagcctcgcctccttcgccctcctccagtactacgagatggacgcctggcaccacctcagcgccgccgtcgagggctccgtcaccccctgggagaggtgccacggggtcgactacagggagtacttcgccaaggaccccgtggccaaccagctcctcagcgacgccatgaccagccataccagcatggtcacggaggcgctggtggagggctgcaggaaggccggggcgctggacggggtgcgctcgtttgtggacgtgggcgggagcacgggggtggccgcgagggccgtggcgaaggccttcccggggatcaagtgctcggtgtttgatctgcctcatgtgatcgccaccgcgccggagtgtcccgaggtggagaggattgaaggggacatgttcgcgtcggtgccggagaccgatgtggtcttcatgaagtcggtgttgcatgattggggagatgaggattgcgtgaagatactaaagaaatgcaaggaagcgatagcggggaaggagggagggaaagtggtgatattagacatagtgttggatgtagaatcgagttacgagttcaagggggcgaggttggggatggagatggacatgttggtgacagtgggagggaaggagaggagcgaggcggaatggcagaagttgatcaaggatgcaggttttagccggtacaagatcacacccattgttgccattgaatccattattgaagtcttcccttag

SEQ ID NO: 627 - DNA, 1065 bp, Cissampelos mucronata
atggcaacgacagagcaggaagagagcctgcgaggccaagcagaggtctgggactgcatgttcgccttcgcggactccatggccctacgatgcgccctcgaactccggatacccgacatcatccactcccacaaccgtccgatcactctctccgagattctaacttccatcccctccccttccccggaccacacgtgcctctcacgcattatgcgcctcctcgtccgcaagcgcatcttctccgtcaccaccacgtcatcgggtgccgcacaagaacccgcctacggcctcaccagatcctccaaatggctcgtgacccgaggagccgagctgaccctggcgccgatggcgctgatggagacccacccggagatgatggcgccgtggcattggctcagccgatgcgtcgcggagggcggagccgcgttcgagaaggctcacgggatggagatatgggagtacgcttcggtgcacccggagatgaataagatatttaacgcggggatggagtgtgcgtcgaaggtgttggtgaggacgctgttggtggggtacgagaaggggtttgatggggtggggacagtggtggacgtgggtggtgggaccgggatgttgatcggggagatcgtggccgctcatccggggctgaaagggatcaactttgaccttccgcacgtggtggcgagtgcaccggatcaagccaatgtggttaacgtcgcgggggacatgttcgtggaggtgcctcgtgcggatcttgtggttatgaagtggataatgcatgattggaacgacgaagactgtacaaagatcttgaagaactgtcgaaaggcgataccggagaagggagggaaggtggtgattatagatttggtgctaaggccagaaggcaatggattgtttgattcaacaggggttgtgtttgatttgttaatgatagctcacagctctggtgggaaggaaaggaccgagaatgaatggaaaaaaattttaaaggctggaggctttcctcgctataatatcattcaagtcccaaccttagtgtccatcatcgaggccttcccactttga

SEQ ID NO: 628 - DNA, 1107 bp, Cissampelos mucronata
atgagctccatagcagcaggagcagagcaagaacaagagatgaagttgcaagcccaagtgtggaaccacgtcgcaggcggcttcgcgaactccatcgtcctcaaatgcgccgccgatctctccctcttcgacgccatccaggacgtccacaacaagcaaggcaaaccagtcactccatccacactaattaggacttctcccaacttgtctcccatgaaccctcacaagttgtttcgcctccttcgcttcttggctcacatgaaactcttaaacatccatgcttttgatcatgataatgttgatgatgaagatgaagtgtgtttctctctgactgaattagccaagttcatgctgagaagcaacgagaagaacattgtggattgggtgttaggagtccccgacgagcccgccattaacgcttggcatcagctggggaactgcatgtcttttccgagcgaagggccgacggcgttcgaggaggagcatgggaaaaccttgtgggagttcgcgagggacaacgcggatatgaacaaggtgttcaacgacgccatggcttgcgatacgaggttggttatgcccgcgtttgttgaaggttgcagggatgttttgaagggtgtttcttctttggttgatgttggtggcggcactggcactgctatgagttatgttgtcaaggctttccctcatgtcaagtgcactgtttatgatcttccccatgttattaccacgtcgccggagtatcccggggtggagctagttgggggagacatgttccaatctgttcctcatgcggatgctgtcctattgaagtatatgcttcacaattggcaaaatgagggatgcgtgaagatactaaagaagtgcaaggaagcagttccaaaggagaagggcaaggtgatcataatagatgtggtgatagaccaagatgaggataattacgatgttacccacataaggcttagtttggacatggacatgatgggaatgtctgggggcagggagaggacaaaagaggaatggagtgtgctcatgaaattggctgggtttagtcgctatgaaataattccaatttttgccatgcaatcagtcattgtggcatacccttaa

SEQ ID NO: 629 - DNA, 1116 bp, Cissampelos mucronata
atgggctcaacccacaccgatgtgtcatcaacggtggtgatgaccccggcagaggaagaagaggcgtgcatgtacgccatgcagttggcgagcgcgtcggtgctgcccatggtcctcaaggcggccatcgagctagacgtgttggagaccatagcccatgcaggcccaggggcccatctggccccgtccgagatcgtcgctcgccttccgaactgcacgaatcccgatgcggcggtgttgctggatcggatgctgaggttgctggcgagttatagggttgtgagttgtagcgttaggactacggaggttggtggggtggagagagcggagagggcgtatgggttgggtggggtgtgcaagtttttggtgaagaatgaagatggggtgtccatggcccctcttgtgctcatgaaccaagacaaggtcctcatggagagctggtaccacttgaaggatgcagttcttgacggtggtattccattcaacaaggcctatggcatgacagcatttgattaccatggaactgatccaaggttcaacaaggtcttcaacaggggaatgtctgatcactccaccattaccatgaagaagctcctcgaaaattacaaaggcttcgacgccctcaagtccgttgttgatgtcggcggaggcactggagctactcttaacatgatcatctccaagcaccctaccatcaagggcatcaactttgatttgcctcatgtcattgaagatgcccctacttatcctggtgttgaacatgttggtggtgatatgtttgtcagtgttcctaagggggatgccattttcatgaagtggattcttcacgattggagcgacgagcactgtaagaaattcttgaagaactgctatgcggcgttgccagaagacgggaaaatgatcatcgtcgaatcgattctgccagtgttcccagagacaaaccttgcagcccatggttccttccaactcgacaacatcatgttggcgcataaccccggagggaaagagagaacttcgaaagatttcgaagggttggcgaaggaagcagggtttgctggctttaatgttgtgtgtggtgcctataactcttggatcatggagttcttgaaaaagtag

SEQ ID NO: 630 - DNA, 1065 bp, Cissampelos mucronata
atgagtgagggagaccatagtacgaactacctagtaggccttggccttggccggttgatatgcattccaatggcattgagagcagcaatggatctccacgtcttcgagatcattgccgcagccggacctggagcgctactctcaccttcagagatagtctcccggatcccaaccaccaaccccaatgccgctgcagcccttgatcgaatcctcataatgctggcagcggggtcgcttctctcggtcgccacaaggcactccaccgctgagagggcttacggactcacaccagagtctctaaccctggtgcccagcaaggaaggagtgtcggtagtgcccatgatgctactcgcgtttgatgatgcattgatgaagtgctttcacgggctgaaacatgcagtgctggaggaagggtgcgtgccattcgataagtcacacggcatgaacttcttcgagtacgcggagaaggaaccgagggtgaaccgagtgtttaacgaggcaatggcagctagttctgccattgcgtttcaggaggtgttcaaggcgtatgatgggttcaaggaggttaaggagttggttgatattgggggtgggattgggacctcgcttaggagtgttgtctgcaagtacccgcatataagtgggatcaattttgacttgagccatgttattgccggtgcaccaccttatccaggtgtgaagcatgtggagggagatgtgtttgaaggcattccaaacggacaaaccttgatgcttaagtgggttcttcacgactggagcgacgagcactgcaagaagatactgaagaactgttggaatgctttgccaaaagaaggtgggaaggtgatagtaatagagtatgtgcttcctgaagagcttgggaacaactctggtgatagcttcaatgcattggttgctgatttatttatgatgaatttgaattcgggaggcaaggagaggactttggctcagttccgtgatctcgcaaaaattgttggattttttgaaattatggttttcccaatttgtcgagaccttcatgtcctggaattcctaaagaaatga

SEQ ID NO: 631 - DNA, 1056 bp, Cissampelos mucronata
atggaagacaaatctgcatcaaaagtgatggaattgctaggcctggggcctctccaaatgtctctaaaacttgcaatagagctcaaactctttgaaatcataaactcaagtggccctcaatcaatgctctctgcttcacaaattgcatctcacctgcccacatcaaactcctctgcttcatcatcactagacagaattctaagtctcctagcaagtcattcaatcttaacaacaacattaggagagaagggagagaggttatatggattgacacccatttgtaattactttgtgcctgatcaaaatagggtctcacttggaccattgttcatgtttttccatgacaaagtgttgatggagagttggagctatttgaagaacagagttcttgaagggtctgttccatttaacatggctcatgggatgggggtttttgattatatggctaaagatgagaggtttaggagagtgttcaatgagggactttacaatcactctgtatctgtcatgggagatctccttgagaagtacaaggggtttgacgagagtgtggctgaagtggttgtggacgtcggtggtgggatcggcgcttcgatgaagatgcttgtttccaagtatcctcacattaagggtgtcaactttgatctccctcatgtcgttgcggatgctcctccttctccaggtgtggagcacgtctcgggagatatgttcaaaggagtgccaaatggtgatattatgttcatgaagtttatcctccacacattcgacgatgaacattgtgtggctatattgaagaactgttggaatgcattgcctgaacatgggaaggtactcatcgtggagcatgtgctgccaccgagcaacatatcggaataccctgatgaatctcgcttggctttcacagccgatgctatgatgttggtttacagggatggaggcagagagagaacactcgtcgaatacgaagagcttgcgaaaagaggtggatttcatggcatgaaagctttcccttgctctcttggcattattgctattgagctacaaaagggatcttaa

SEQ ID NO: 632 - DNA, 1029 bp, Cocculus trilobus
agaccaagcagcccaagcccagctgtggaagttcatctatggctttgcagagtcactagtcatcaaaagtgcaattcagcttgacatcccagacatcattgacaaccatggcaagcccatcaccatctccgagcttgcttctcggattccctcgcaaggccccgttgaccacgaccgcttgtatcgaatcatgcggtacttggtgcacatgaagctcttcacaaaagagtccatcgacggtgaagatcaatatgggcttgcaccaccagcgaaatacctagtgaaggggtgggagaaaagcatagtgccttcaattctatgcattactgataaggaattcatgtcaccatggtaccatctcaaggaaggtttgtctaatggcgacaaccagaccgccttcgagaaggctttgggggtaaacatatgggattatatgtctaagaacccaaagaagaacaacatcttcaatgaagccatggcttgtgatactaggcttctcatgtctgcattggtgagtgaatgtaaggacatgtttcaagggattaagtcattggtggatatcggcggtggcaccggaaccgctgttaggtacattgccaaggccttccctcatataaactgcactgtttatgatctccctcatgttgctgctgattctcctacttatcccgaagtgaatcgcatcgaaggtgacatgtttaagtacattcctagtgctgatgccatcctaatgaagtgcattcttcatgattgggccgacgaggaatgcattcagattctgaagaagtgcaaagaagcattgccaagtactgggggaaaggtgatccttgtcgatatcgtgctaaacgcatattcggagcatccatactcaaagatgaggatggtgatggacttggatatgatgctgaactgtggaggraaagagagaacagaggaggagtggaagaagctcatctatgcagctggttttagtaggtacaatataaggcaagtcaatgccatacagtctgtcattgaggtttacccttg

SEQ ID NO: 633 - DNA, 1032 bp, Cocculus trilobus
atggaagaagaaatgaaagctcaagcccaagtgtggagatacgtgtacggtttcgcggagtcactgactctcaaatgcgcgattcaactcaacatcccggacatcctccatcaacacggccgacccatgactctctccgagttagcctctcatctccctctccccaccgtaaaccaagaccgattattccgagtcatgcgttatctcgtccatatgggcctattcgacctagtcgactcgcccgattcaaagaaatactccctcaactcggcctcaaagctcctcatcaaaggccaagacaagagtttggcatccttcgctctcctacagtactacgagatggacgcctggcaccacctcagcgccgccgtggagggcggagcgacgccgtgggagaagtgccacggcgtggattacagagagtacttttccaaggactcggtggcgaatcagttgttgagtgatgccatgacgagtcatactagtatggtgaccgaggcgttggtggagggctgtaagaaggctaatgtgctcgacggagtccgatcgtttgtcgatgtcggtgggagcaccggtgttgcggctcgagccgtggccaaggcctttccgaacgtcaaatgctcggtgtttgatttgcctcatgtgatcgccactgcgccggagtgccccgaggtgacgaggatcgaaggggacatgtttgtctccatccctgaaacggatgttgtcttcatgaaatcggtgctgcatgattggggagatgaggattgtgtgaagatattgaagaaatgcaaggaagcaatagcagggaaggatggaggaaaggtagtgatattggacatagtattggatgctgagtcgagttatgagttcaagggggcgaggttggggatggagatggacatgttggtgactgtgggagggaaggagagaggtgaagaggaatggcagaaattgttcaaagctgcagggtacagtcgttacaagatcactcccatcgtggccattgaatctgtcattgaagtgttcccttag

SEQ ID NO: 634 - DNA, 1062 bp, Eschscholzia californica
atgggtttagaatttaatgaagaagttgatatcaaagctcaagctcatctatggaacataatttatggatttgctgattcattagtccttcgttctgcagttgagttaggaattgcagatatcatcaagaacaacaatggttcaatcactgtatcagaacttgcatcaaaactccccatctcaaatgtcaattctgataacttatatcgagttttaaggtacttagtacacatgggtatcttaaaagaaaccaaatccaccattaatggaggagaaattaagaagctttactcacttgaaccagttggtagtttactagttaaagatgcagaaagaaatatggtacccattgttttagggatgacccaacaagattttatgattccatggcattatattaaggaaggattgggtgaaggaagtactgcttttgagaaaggaatgggtatgacactttgggaatatttagaaggtcatcctgaacaaggtcatttgtttaatgttggaatggaaggtgaaactagacttttgactaaaaccctaattgaaagttgtaaagatacttttgaaggtttgagttctttggttgatgttggtggtggaaatggtacaacaattaaggcaatttctgaagcatttcctcatataaaatgtagtctttatgatcttcctcatgttgttgctgattctcatgatcttcctaatattgaaaagatccctggtgatatattcaagtttatacctaatgctcaagctatcttactcaagttgatcttgcatgattggagtgatgaagactctgtcaagattctaaagaagtgcagagaagcagtaccacaagatacaggaagggtgatcatagtagatgtagccctagaagaggaatcagaacatccactaacaaaaacaagattggttcttgatgttgatatgttagttaatactggtggaagggagagaagtgaagatgattgggcaaaattactcaaacttgcaggttttcgaactcacaagataaggcatattgctgctgttcaatctgttattgaagctttcccttag

SEQ ID NO: 635 - DNA, 1053 bp, Eschscholzia californica
atggaaatggaaggagcagacaagattgatcaagcaacccaagccaaaatttggaaacacatctatggttttgcagaatccctagttataaaatcagcagttgaacttgaaattgctgatacaattcacaaccatggaaaacccatgactctatccgagttagcttcaaaattacctgttcaacccgttgacttagaccgtctttaccgagtcatgcgttatttagttcatatgaagcttttcaagaaacaagaagatgaagaagaatcaattaagtactctttattaccaccagccaaatttctgattaagggttgggagaaatcaatggtgagtgcaattcttttaatcaatgataaagatttcatgtctccatggcatcatttgaaagaaggattagtgaataattctaatgcttttgataaagcattagggaaaagtatatgggattatatgagtgctaatcctgataaaaacaaggtttttaatgaaggtatggcttgtgattctagattagtatcatcagctttagttaatgagtgtggaaatattttccaaggaattcaaactcttgttgatgttggtggtggaactggaactgctgtcaaagctgtttcaaaggctttcccacatattaagtgtagtatttatgatctcccccatgtgatttctgattcccctgatattcctaatattgtcaaaattgagggagatatgttcaaatcaattccaagtgctgatgccattctcatgaagtgcatccttcacgattggaacgatgaggaatgcattgaaattctaaaaaaatgcaaagaagctgtgccgaaggaagggggtaaagttattatcgtcgatatagttctagacatggaatcaaaacatccttattccaaggttagactaactctagatttggatatgatgctcaatactgaaggaaaagagagaacagaagaagaatggaagaaattgattgatggtgctggttttgcaagttacaaaatcactcaaatttctgcattacaatctgtaattgaagcttttccttattga

SEQ ID NO: 636 - DNA, 1047 bp, Eschscholzia californica
atggagttagcaaacaagagtgatcaagcaacccaagctaaagtatggaagcatatctatggttttgctgaatcactagttctaaaagcatcaattgaacttcaaatagctgatacaattcaaaatcatggaaaacccatgactctaactgagttatcttctcaattaccaaatcaaccagtcaactcagacaggttatacagagtcatgcgttatttagttcatatgaaactttttcagaaacaggaatcctccattaatggtgaaattgaatactctcttttaccacctgcaaagtttctattaaagggtagtgagaaatcaatggtttcatcaattctagcaaaaacccataaagatttcttagctccatggaattatttgagagaaggattgatgggaaattgtgatgcttttgagaaagcattaggaaaaagtatttgggaatatatgagtgagaatcaagaaatgaatcaactttttaatgaatcaatggctagtgatagtaatttagtaacatcagctttggttaatcagtgtgaaaatattttccaaggaattcaaaatcttgttgatgttggtggtggaactggaactgctgtgaaagctatttctaatgcttttcctcatattaaatgcagtatttatgatcttcctcatgttatttctaattgccctgagattccaaatattgttaagattgaaggtgatatgttcaaatctattccaagtgctgatgctatctttatgaagtgcactcttcatgattgggatgataacaaatgcattcaaattttgaagaattgcaaagaggcattacccaaaggaggaaaagttatcatagttgatgttgtattagagagggagtcgaaacatccttattcgaagattagacatacatttgatttgagtatgatgttaaatactggaggaaaagagagatcggttgaagaatggaagaagttattcgatgatgctggattcccaagttttaagatcactccaatttctgcagttgaatctgttattgaggcttttccttactaa

SEQ ID NO: 637 - DNA, 1113 bp, Eschscholzia californica
atgtctatgaaaatcaaaactgacaaatgcttcatggagttcgacaagaataataatgttgaagatcaagcaatggaaactagaatatgggatatcacttacggcttcgctgggtcgcttgtcctaaaatgtgcaatagagctcgaaattgccgatataattcacaaacatggcgagccaatatcactatcggaattagcctcacaacttcctgtcaataagccaaccgatttatctcgattataccgagttatgcggtacttaatccatatgaagctcttcactaaagagataaatgacctcggagaagtaaaatatggacttgcaccatctgcaggaaaattcctcgttagaagttcagacgataaatcaatggctacgttaatactaggagcacatcaagaagctttcatggctccatggcatcacctaaaggagagcttgagccatgattctagtcaaagtggtactatatttgagaaagctttagggaagagtatatgggaatatatgggtgacaatcaagagatgaataagcttttcaatgagtgtatggctagtgatagtagaagaatggtggccgcgttgattagcgattgtaagaatgtatttgaagggttaacgacactagtagacgtcggtggaggacccggaacagctgctaaagccatttctaaagcttttccacacataaagtgtattgtttatgatctacctcatgttgttgccgagtcttcttctaccgataccgatgtcatttggatcgaaggtgacatgtttaaatatatgcctagtgcagatgcaatcttaatgaagtggatacttcattgctgggaagatgaagaatgtattcaaattctaacgcaatgtaaaaaggcagtacctaaagttggggggaaggttattatcctcgatattgttgtagatgagaaatcgaatcatccacacacgaaaacaagactcacattcgatttggacatgatgcttaacagcggagggaaggaaagaacagaagaagaatggaagaacttgctggttcattctgcaggatttacttcttacaagatcacacaaatatctgctctccaatctgtaattgaagcttatccttaa

SEQ ID NO: 638 - DNA, 939 bp, Eschscholzia californica
atggagttagcaaacaagagtgatcaagcaacccaagctaaagtatggaagcatatctatggttttgctgaatcactagttctaaaagcatcaattgaacttcaaatagctgatacaattcaaaatcatggaaaacccatgactctaactgagttatcttctcaattaccaaatcaaccagtcaactcagacaggttatacagagtcatgcgttatttagttcatatgaaactttttcagaaacaggaatcctccattaatggtgaaattgaatactctcttttaccacctgcaaagtttctattaaagggtagtgagaaatcaatggtttcatcaattctagcaaaaacccataaagatttcttagctccatggaattatttgagagaaggattgatgggaaattgtgatgcttttgagaaagcattaggaaaaagtatttgggaatatatgagtgagaatcaagaaatgaatcaactttttaatgaatcaatggctagtgatagtaatttagtaacatcagctttggttaatcagtgtgaaaatattttccaaggaattcaaaatcttgttgatgttggtggtggaactggaactgctgtgaaagctatttctaatgcttttcctcatattaaatgcagtatttatgatcttcctcatgttatttctaattgccctgagattccaaatattgttaagattgaaggtgatatgttcaaatctattccaagtgctgatgctatctttatgaaggtaatacctaacttttttggtagtttctacctttgttttgtttatctgaatctcataccttatgtctcactcgattgtccaaatcaaatctacaagaataaagataagaaaatcttgtctttacatatgggacagccccatcgaaggcgacacttttcgagatgtttttatacgcgcaacgcctag

SEQ ID NO: 639 - DNA, 1071 bp, Eschscholzia californica
atggataaacaagaagatgtggaagaagaaattctgcaaggtcaagctgaaatatgtaaacacatgtatggctttgttgactccatggctttaaagtgtgtagtggagcttggtatacccgacattatacattctcatggtcgtcccatcactatttctgaaatcatcaataatattcctaacgtatctccctcttcagctggcattgactacctccctcgaatcatgttattactggcacgtaaacgagtattcgccactcataaacccgatgcagatgtgaccgaaacacgatatgggttgacaccttcatcgaaatttctattaaaagattctgatttcaaccttgcaccgttggttctaattgagaaccattcatatctaatggatccatggcactatctcggaaaatgcattcaagaaggtgggtcggcttttgacaagtcccatggttcggagatatggaaatttgggtccgaaaactcacaattcaataagctattttgtgctggtatggcatgtatggcgaagaccacactccatgccatattggtcaaatatcaagatggatttaatggtttagaaacgatagttgatgttggtggtggaacggggatgatgcttagtgggatagtgaagaaaaacccacacttaaaaggcataaattttgatcttccgcacgtggttaaggaagcaccaagctactttggtgttacacacgtaggtggagatatgtttgttgaaattcctcgcgccgacgcagtttttttgaagctaatactacatgattggaatgaccaagattgtgtgaggatcttgaaaaattgtaagacagcaattccgaagaacggaaaactcattattattgattgtgtgctgaacccaaacggagagggtttatatgatgacctcggagttgcatttgatctggcaatgagagtattcacttctggtggcaaagaacggagtgaagctgaatggaaaatattgttggaagacggaggttttcctcgctacaaaatcattcgtattcctacaattccatcactcatcgaggcctatcctgaatga

SEQ ID NO: 640 - DNA, 1086 bp, Eschscholzia californica
atggaagagattctaaaggttgaggaagataggcttgagttacaaggccaagctgatatatggaagtacatgtttgcttttgtagattccatggctttgaaatgcatagtagagcttggtataccagatattatacactcttatggccgtcctatcacgatttctgaaatcatcgacaacattcctaacctatctcctacttataacgttaattacctctctcggatcatgagcctactggttcgcaagcggatctttgtcgttcataaacccgacttgaaaaacggtactgatgtgaccgagtccccctacgggttgacatcatcctcgaaatggttactaaaagattcagagtttagccttgtgccattagttttagctcagaatcatccatggctcctggatccatggcagtatctcggaaaatgtgtgcaagaaggtgggttgcctttcgccaaggctcatggatcggagatctgggaattcgggtcagaaaatccagagttcaataaattatttaacactggcatgacatgtacagctaaaattgtagttaatgctatactggtcaagtatgaggaaggatttaatgatttaagatccatcgttgatgttggtggtggaacggggatgatgattggtgaaattgtgaagaaatatccacacatacgaggaattaattttgatcttccacacgtagtggccgcagcacctgagtaccctggtgtatcacacgtccagggaaatatgttcgatgaaatccctcgtgccgatgcagttatcatgaagtggatactacacgattggaatgatgaagacagtgtacgaatcttgcaaaattgcaagaaagcgattccaaagaatggaaaagttattatcattgattgtgtgttgaaaccggacggcaaagacttatttgatgaaaccggagtggtacttgatttggtgatgattgcacatacttcgggtgggagagaaaggacagaagtcgaatgggaaaaattgttgaaagatgcaggatttcctcgctacaaaatctctcatatccccacaattcaatctattatcgaagcgtatccccaatga

SEQ ID NO: 641 - DNA, 1089 bp, Eschscholzia californica
atggagaagggaaaattagaggtaggagaagaaatggaattgcaaggccaagctgaaatatgtaagcttatgttggccttcatagattccatggctttgaaatgcgcagttgaacttggtataccagatattatacactctcatggtcaacccatcactctttctgaaatcatcaatggtattcctaacttatctccctcttttgacattaattatctgtttcgaatcatgaggttattggttcggaatcgggtattttccgcttatgaacccgacctaaaagatggttcaagtggaactaaaactctgtatggtttgacaccatcatcaaaatggctagtgaaagattccaagatcagccttgcgccacttgttctggctgagaaccatccatggctactagacccatggcactatctagggaaatgcgttcaagaaggagggtttgcttttgccaaggcccacgggtccgagatatggaaatttgggtctgaaaatccggaatttaataaactatttagcgttggtatggcgtgttcgtctaccctcgtagtggatgctatattggacaactatcatgaaggattcggtgatttagaatcaatagttgatgttggtggtgcaatcgggacgttgattaatgagatagtgaagaaatacccgcatataagaggcacaaattttgatctaccgcatgtggtcgctgaagcacttgaaaaccctggtgtagcacatgttggcggtgatatgtttgttgaaattccttctgccgatgcagtaatcttgaagtgggtactacatgattggaatgatgaagattgtgtgaagatcttgaaaaattgcaataaagcaatttcaaataaaggaaaactcattattattgaatgtgttttgaaaccggatggggaaggcctttttgatggtcttggacttgcatttgatttgctaatgatcgcccattcttctggtgggagagaaaggactgaagcggaatggaaaaagttgttgaaagctggaggtttttctcgctataaaatcactcctattaagggaattccgtcaataattgaggcttaccctgatatttaa

SEQ ID NO: 642 - DNA, 1062 bp, Eschscholzia californica
atggacgaagaaatcattctaggtcaagctgatatttgcaaatatatgtatggttttgttgattcaatgactttgagatgtgtagtggagcttggtataccagacattatacactctcatggacgtccaatcactttgactgaaatcctcaatggtattcctaacttatcttcctcttttgacattaattatctccaaggaattatgacaatactggtccgcagacgggtctttgctgttcataaatttgatccgaaagacggaacaaatctgacagagacccgttacgggttgactccgtcttcaaaatgcttactaaaagattctaagttcaatcttgcaccattcgttctacttgagacccatccatggataacagatccatggaattatttaggaaaatgtgttcaagaaggtgggtctggttttgtcaaggcccatgggtcggacgtctttaaatttgggtcagaccatcccgagttttttaagctattctacgatggtatggagtgctcgactaaggtcttagtgcatgtagtactagacaagtaccaacaagtatttaaagatgtaaaatccatagttgatgttggtggtggaactggaatgatgattagtgagatagtgaaaaatcacccaaatataaaggggataaattttgatctaccacatgtggttgctgaagcacctgattaccctggtgtggaacatgttggaggagatatgttcgtcgagattcctcaggctgatgccattacaatgaaggggatactccacgactggaatgatgatgcctgtgtaaggatcttggaaaattgcaagaaagctatcccgaaaaacggaaaagtcattattattgattgtgtgttgaacccggacggtgacgatttatttgatgacattaaagttgtatctgatctaggaatgagggtacattgttcggacggcaaagaaaggactgaagcggagtgggaaaagttgttgaaaaagggagggtttcctcgttacaaaatcactcatgttgtcacagttcaatctatgattgaagcttatccggaataa

SEQ ID NO: 643 - DNA, 1065 bp, Eschscholzia californica
atggaaacccaagtaagaaatcaagaagaagaaattcaatggcaaggtcaaatatggaatcatatttgtggtagtgttgattcagctgttcttaaatgtaccattgaaataggcttacttgatacgattcaaaattcaaaaaaacccattacccttactcaactatcaaattctccatctttatcttcattcaaaacccagaacttatacagattattaagatacttatctcagatggatctagtaactatcacaactaatgaagaagaagaagaaactttttcattaacagatgtatcaaaattactactttgtgatcaagaaaggagtttgaaggattgggttcttggaatcgacgacgaacattcaatcaatagttggcatgagttgggtagctatatttcttctccggacgattctccgacaccatttgtgaaattacatggaaaaacaatgtgggaattagcagaagaagtaccagaagttaatgaattgattaataatggaatggcttgtgatacaagaatggtaatgcctgcatttgttcatggttgtgagaagattttaaaaggggttaagaaattagttgatattggaggtggtactggagctgccatgaattatgttgttaaagcttttccagagataaaatgtactgttttcgatttgcctcatgttgttgcaacggcgaaggagattcctggtgtcgaaatggttggtggtgatatgtttgaatcaatcccaaatgctgatgctcttctcttgaagttcatgctccataattgggtagatgaagaatgcataaaactactaaaaagatgtaaagaaacaattccaagagatcaagggaaggtgattataatagaaatggtggtagatcaagatgaagatgattatgatctaacaagggcacgattaagtcttgatcttgatatgttgttgagttcaggaggcaaagaaaggactaaagatgaatggaaaaatctacttgagagtgctggttttagcaaggttgaattcatttccatatttgcaattcaatctgttattgtggcttatccttag

SEQ ID NO: 644 - DNA, 1074 bp, Eschscholzia californica
atggagatcaaaatggaagatcaagaacaagaaatgaaatggcaaggccaaatttggaaccatatatgtggcagtgttgattcaatagttttgaaatgtgcaattgaattaggcatatttgatatcattcacagttcagctggtagctctatgaatctcaccttatctgaactatcaaaatctctttccctactttttcctaacaaacccgaaaatttatatagattgctaagatacttatctcatatgaatctcataaccatcaccactgttgaagaaaatgaaatattttcattgacatatttgtctaaactactacttagaaaccaagagaaaagtttaagagattgggcaattggaatcacagacgaattaactgtatcggtttggcatgaacttggtagtttttgttcgaatacaacggattcgacaccttttgagaaagttcacggcaagactgcatgggaattaccagaagagaactcaagattgaacatggttataaataatatgatggctagtgatacaaggttgattatgcctgcatttatacaaggttgtggtaaggttttcgatggaattacgtctttagttgatattggaggaggggttggaattgcaatgagttatgttgttaaatcttttcctcacataaaatgcacagttttcgatctacctcatgttgttaattcaataacggaatatccggtcggtgtggatatggttggaggtgacatgtttgtgtctattccttgtgcagatgctattttgttgaagtacattctccataactgggaagacgaagggtgcacaaaaattctagaaaaatgcagagaagcaattccggctgagggaggaaaggtgataataatagaaatagttatagatcaagatgatgatgatgataatcttgcacaagcaaagttaagccttgatcttgatatgatggtttgttcaggagggagggaaagaactaaggatgaatggaaaaagttacttgaaaaggctggttttagcaggattgaaattgttcctatttgtgccatacaatcagttattgttgcacaaccttaa

SEQ ID NO: 645 - DNA, 1098 bp, Eschscholzia californica
atgggttcaacagaaaaccaaatgaagaacacccaagaagatgaagaagttgaagcttgcaaatatgctatgcaattagcaagtgctacagtaccagctatggttctgaaaacagcaattgagcttgatctacttgaaattataactaaatctgatttgggtgcaaaactcagttcaactgagattgcatcaaaaatcccaaattgcaaaaatcctgatgctcctgttatgcttgatagaatgttgagactcttagcaagttataatatcctaacttgttcattgagagaaattgaagggggtaaggttgaaagaatttatgggcctgcaccagtttgtaaattcttgaccaagaatgaatttggttgttcaatggctcctttggttctcatgaatcaagataaggtccttatggaaagctggtactacttgaaagatgcagttcttgatggtggaattccatttaacaaagcttatggtatgacagcatttgagtaccatggaacagatccaagattcaacaaagtatttaacaaaggaatgtctgaccacacaactataaccatgaacaaaatcttagaaacttacaagggtttcgaaggtttgaattcgattgtagatgttggaggaggtattggtgccacagttaatatgatcgtctctaagtacccgacaataaaaggtattaacttcgacttacctcatgttattgaagatgcaccagcttatccaggtgtcgaacacgtaggcggtgacatgtttgttagtgtaccaaatggagatgcaatctttatgaaatggattcttcatgattggagtgatgaacatagtattaagttcttgaagaattgttatgaagctttgcctcaaaatgggaaagtgataatagttgaatgtataattccaatttcggctgagtgtggtgagagaagtcatggggttttccatttggacaatataatgttggctcacaaccctggtggcaaagaaaggacagagaaagattttgaagaattggctaaaaaggcagggtttaagggttttaaagtggtttgttctgcttatgagacttttgttatggagttcactaagaactaa

SEQ ID NO: 646 - DNA, 1062 bp, Glaucium flavum
atgggtgtcagtgataacaaaccagaatctcaagaggtggacatcaaagctcaagctcatctctggaacatcatttacggatttgctgattctctagttcttcgttgtgcagtagaaattggaattgcagatatcatcaagagcaacaacgggtcaatctctgttacagagctagcatcaaagctcccaatcacaaatgtcaattctgataacctctaccgtgttctaaggtacttggtacacatgggtatcttgaaagaagtttcagacagtaatgaagtcaagctttactcacttcaaccagtagctactctgctcttaagagatgcagagagaagtatggtgcccatcattttgggaatgacccagaaggatttcatgattccatggcatttcatgaaagaaggattgggaaatgatactactgcatttgagaaagggatggggatgacaatttggcagtacttggaagggcatccagaacagagcaatttgtttaatgaaggaatggctggtgaaactaggttactaactaaatcacttattgatggttgcagagatacttttgaaggtttaacttcactttgtgatgttggaggaggaaatggaacaactattaagggaatttatgatgcgtttcctcaaataaaatgctctgtttatgatcttcctcatgttattgctagctctcctgaacacccaaatattgaaagaattcctggtgatatgttcaagtctgttcctagtgcccaagcaatcttactcaagttgatcttgcacgattggaccgatgaagagtgtgtcaacattctaatcaagtgtagagaagctgtaccaaaagacacaggaaaagtgatcatagtggatgtagcactagaagaagagtcccaacatgaacttacaaagactagattgatacttgatattgatatgttggtgaacactggtggtagagagagatctgaagatgattgggaaaagttgctcaaacgtgcaggctttagaggtcacaagatcaggcacattgcagctattcaatcagtcatcgaagccttcccatag

SEQ ID NO: 647 - DNA, 1047 bp, Glaucium flavum
atggaagcaaccaagagtgaccaagcaaatcaagccaacatttggaaactcatctatggttttgcagaatccttagtcctaaaatgtgcaatccagctcgaaattgccgatacaattcacaaccatggagaacccatgagtctatctgagttagcttctaaattacctgtccaaccagtcaattcagaccgattataccgagtcatgcgttacttagtccacatgaagctcttcaacaaagagaagacctccattaatggagaattcaaatactcattagccccacctgcaaaattcttgataaagggttgggagaaatcaatggtagcttcaattctagcaatcaatgataaggattttttggcaccatggcatcatttgaaggatggattgagtggtgattgtgatgcttttgagaaggctttgggcaaaagtatatgggtttatatgagtgagaatcctgagaaaaaccagctttttaatgaagcaatggcttgtgatactagattagtaacatcagctttggtgaatgattgtcaaagtgttttcaaaggaattaatacacttgttgatgttggtggtggaactggaactgctgtcaaagctatttctaaggctttccctcatattaaatgcagcatatatgatcttcctcatgttattgctgattctcctgaaattccaaatgttgttaaaattgaaggggacatgttcaaggccattccaagtgccgatgccatcctaatgaagtgtattcttcatgattggaacgacgacgaatgcattcaaattctaaagaaatgcaaagaagcagtaccccaagaaggtgggaaagtgataatcgtcgatgtggtactaaacatggacttgacacatccctattcaaagattaggctaacactggatttggatatgatgcttaacactggaggaaaggagagaacagtggaagaatggaaaaagctcattgatgctgcaggatttgctagtttcaagattactgaaatttctgcagtacaatctgtaattgaggcttttccttattaa

SEQ ID NO: 648 - DNA, 1098 bp, Glaucium flavum
atggtaaaggtcgacgatcgacgagaggatgaggaagagcggttgcgaggacaagctgagatatgggacgtcatgctagccttcgtagattccatggcgttgaagtgtgcagtagagcttggcataccagacataataaactctcatggccgtgccattaccttattagaaatcacaaatgctatcaaaaccaactctcaactttcctcatctccagatatcaattgtttgtcacgtatcatgagattattagtccgtaaacgcgtcttctcttctcaatcccatcccgaagccggcgaaaccgacgaaacgatgctatacaacctcacgccttcctcaaaatggttactaagagactcggaattcagccttgtcccaatggttctatttgagcacaatccaaggctaatggctccttggcattacttgaccaaatgtgttcaagaaggtgggtttgcttttgaaaagacttatgggacacaggtttgggattacgccttggctaatccagatatcaataagcttttaaatgatgcaatggagtgcacggctaggataatagtcgttacgttattggctgcgtataaggagggattcgacgggattgaaacgatcgtcgacgttggcggcgggacgggaatggtggttattgaaattgtgaaggcacatccacatatgcgtggtgtaaatttcgatctgccgcatgtggttgccgcggcaccggaatttgaaggtgttaaacatgttggtggggatttctttgtcaatgttcctcatgcagatgcagtcatcatgaagtgggtattgcacgactggtgcgacgaagacgctgtaaggatcttgaaaaattgtcgaaaagctataccgaaagacaccggaaaagtcatcatagtggatttcgtgttgaagccggacggcaaagagctatttgatcacatgggactggtgtttgatatgttaatgatggcacatagctcaaatgggaaagaaaggactgaagttgaatggaagaagttactaaatgatgctggtttccctacttacaaagtcatcaaaattccaactcttgggtccattattgaagcctatccttattaa

SEQ ID NO: 649 - DNA, 1071 bp, Glaucium flavum
atggagatccaaatgggagatcaagaacaagaaatgaaaaaccaaggtctagtatggaacaagatatgtggtagtgttgattcatcagtactcaaatgtacaattgagttaggcttacttgacacaatcaacagttcatcatcaaaacccatgatcactctttctgaattatcatcaacttctccatctttacattcaatcaaaacccaaaacttatatagattactaagatacttgacccatatgaacctcataaccatcaattccactgaagcaactgaatcattttcattaacagacttagccaaattacttttaaaaacccaagagagaagtttaaaggattgggtactcggtatcgacgacgaacattccgttaacggttggcatgagttgagtagctattgttgttcgccggacgatgcgccgacgcctttcgtgaagttacatgggaagacgttatgggagttagctgaggaagttcctgaagtgaatgaattgattaataatggaatggcttgtgatacaagaatggtcatgcctgcttttgtacaaggttgtgagaaggtattgagtgggattagaaagttggttgatatcggcggcggcaccggggcggctattagttatgttgttaaggcttttcctcagattaagggtactgttttggatttgccgcatgttgtagcgacggcaccggagattcctggtgtggaaatggttggtggtgacatgtttgagtctattccacatgctgatgctcttctattgaagttcatgcttcataattggaaagacgaagaatgcataaaactactgaagagatgtaaggaagcaataccaacagatcaagggaaggtgatcataattgaaatggtattggatcaagatgaagacgacgaagatctaacacaagcgaggctaagtctagacctggatatgatgttgagttcaggaggcaaagagagaactaaggatgaatggagagtactacttgaatcagctggttttagtaggattgaattcattcctatttatgccatacaatcagttattgttgcatatccttaa

SEQ ID NO: 650 - DNA, 1098 bp, Glaucium flavum
atgggttcaacccaaaaccaattcaacgccaccacagaagaagatgaagaagcccaagcttgtatgtacgctatgcaattagcaagtgctactgttccggtcatggttttaaaaacagctgtagaacttgaccttctggagatcattaagaaagctggtcccggtgcgcaaatcagttctcttgaaatttcatcacagatcccaaacaacaagaaccctgaggcccatgttatgcttgaccgtatgctgagattattggctagttacaaaattctcacttgctctttgaaagatcttgaaggtgggaaagttgagagagtttatggacttgcacctgtctgtaaattcttgactaagaatgaagttggatgttcaatggcttctcttcttctcatgaatcaagataaggtcctcatggagagctggtaccatttgaaagatgcagttcttgatggaggaatcccatttaacaaggcatatggtatgtcagcatttgaataccacggtaccgatcttcggttcagcaaggtctttaacaagggaatgtcggatcacaccaccatagtcatgaacaaaatcctcgaaacctacaatggtttcgaaggtttaaaatccattgtagatgtaggaggaggagttggtgccaccatcaatatgatcgtatccaaatacccaacaatcaaaggtattaacttcgacttgccttacgtagtccaagaggcaccaacttacccgggagtagaacacgtcggcggtgacatgtttgcaagtgtaccaaaaggagatgcaatcttcatgaaatggattcttcatgactggagtgatgaacacagtgtcaagattttgaagaattgttatgaagctttgcctgaaaatgggaaagtgataattgttgaatgcatcattccagtgataccagatggtactacaagtcatggtgtgtttcatttagacaatataatgttggctcacaaccctggaggtaaagagaggtcagaaaaggaatttgaagctttggctaaggggactggatttactggttttaaagtggtctgttctgcctttgacacatacgtcatggaattctccaagaactaa

SEQ ID NO: 651 - DNA, 1155 bp, Glaucium flavum
atggaaaccaaaggagaagcaaggatgaacagctgctatatttcagaagctggccacttgggtaggttgatatgccttcccatggctttgagagctgctgttgaactaaatgtgttcaatatcatctcagaattcggacctggagcacaactctcttcgcgagatttggtagctaaaattccaacaacaaatcctaacgcacacgtttacttagaacgaattcttcgattgctagccgcaagttccttcctttccgtgtccactagaacttcttcatcgccagaatccatcaccaacactaatggacaccataatggtgacactaatggtgttgttaaccatgacaatgagaaagtaaccgagagggtgtatgggttaacaaaggagtcgcactgtctggtgccgcgtaaggatgatggagtttcattggtgcccatgcttatgtttgttgccgataaaatagtagttgagagcttttataacttgaaagaggtggttcttcaagaagggcgtgtgccatttgacatgactcatggagctagtatctttgagtatgcaggcaaggatcctaggatgaataaagtgttcaatgaagcaatgggagacttctccgtcattgctttcgatgaagttcttaaggtttacaatggttttcttgatatgaaagagttggttgacgttggaggtggaattgggacctctcttagtaacatagtcaccaaatacccatttatccgcggcattaatttcgacttatctcatgttatctcttctgcacctaactacactggagtggagcatgttgcaggagatatgtttgaagagctaccgaaggcacaaaacattttgcttaagtgggtgctacacgactgggacgataagcagtgcctgaaattgctaaaaacttgttggaattcattgccagctgagggtggaaaggttatcgtgatagagttcgtcgtcccttccaagatagcagataatccagagtcctacaatgcgttaacaccagatctccttatgatggctcttaatcctggtggcaaagagcggacactcctcgaattttatgatcttgccaatgctgctggatttgccaaagccaagcctttccccatctctgaaggtctccatgtcattgagtttcataaatag

SEQ ID NO: 652 - DNA, 1104 bp, Glaucium flavum
atgggctcaacccaagaccaattcaaacccactcccatagaggaagaagaagaagcatgcatgtatgctatgcaattagcgagtgcttcggttccggttatggtattaaaggctgcggtagaactcaacgtgcttgaaatcatagccaaacatggcccaggtgcacaaattagtgcatctgctattgcagctcacatccccaacatcaagaacccaaacgcccctgtaatgcttgaccgtatgttgagacttttggctagttacaagatcctgacatgcactgtgaaggaccttgatgaccagggtctagtccagcagagactctatggtcttgcactagtatgtaaattccttgttaagaatgaagatggatgctcaatggctcctttgcttctaatgaatcaagataaggtcttcttagagagctggtaccacttgaaagatgcggttcttgatggtggaatcccatttaacaaggcttacggaatgaacgcatttgagtaccaaggtgccgatcctaggttcaacaagatcttcaaccgaggaatgtctgaccacaccaccataaccatgaagaaaatcctagagacttacaagggtttcgaaggcttgacatccttagtagatgtcggaggaggaattggtgtcactgtcgacatgatcgtttccaaatacccatcaatcaagggaattaacttcgacttacctcacgtaatcaaagatgcaccatcttatccgggtgttgaacatgttgggggcgacatgttcgctagtatcccaaaaggagatgccatattcatgaaatggattcttcatgattggagtgatgagcatggtattaaaattttgaagaattgttatgaagcattgcctgatcatggaaaggtgatccttgttgaatgcattattcctccataccctgagaccagtcttgcaggtcttggcgtgtttcatgtagataacattatgttagctcataaccctggaggtaaagagaggactgagaaagaatttgaagctttggccaaaggaactggttttgccggtttccgagtcatctgttctgcttttaacacttggattatggagttctctaaaaactaa

SEQ ID NO: 653 - DNA, 1062 bp, Hydrastis canadensis
atggatgccaatggaaataaggatcatgaatcatcagacatcaaatctcaagctcatctttggaagatcatatatggttttgctgattcccttgtccttcgatgtgccgtcgaattagaaatcttcgatatcatcgacaataacaaccagcccatcacagtctcggagctggcctctaagctccctattgccgatgtcaattccgataatctatatcggattttacgttacttggttcaaatgaaaatattgaaattaaacaaggttgttgatgatggtgtcaacaagtattcacttcaacccattgctgctttgctccttaggaattctaagaggaatatggttccaatcatccttggaatgactcaaaaagattttatgacttcttggcattctatgaaagatggtttaagtaacaatggtactgcttttgagaaaggaatggggatgactatatgggagtatttagaaggtcatcctgaacaaagtcaattgttcaatgaaggcatggctggtgaaacaaggctcttgacatcttcactcatatctgggagtaaagatatgtttcaaagtattcattcacttgtagatgttggtggtggtaatggtactactattaaggccatttctgatgcttttcctcatatcaagtgcaccctttttgacctccctcatgtcattgctaatgcctatgatcaccccaatatcgaacgcatcccgggtgacatgtttaaatccatgcctagtgcccaagccattttactcaagctaattttgcacgattggagtgacgaagattgtattaagattctaaagagctgcaaggaagcagtgccaaaagatggagggaaggtaattatagtagatgtagcattggatgaggaatcagaccatgagcttaccagcacaagattgatccttgatattgatatgttggtgaacactggtggtagagagaggagtaaagaggattgggaaaagcttgtcaaatgtgctgggttcaaaggttgcaaaatcaggcacatagctgctgtacaatcagtgattgaggtctttccttag

SEQ ID NO: 654 - DNA, 1071 bp, Hydrastis canadensis
atggagatcaaaatggagggggttgaagggcatgagttacttgaagctcaagctcatatatggaaccatacattcaacttcataacctctatgacactcaaatgtgcagttcaattaggcataccagatattatctacaaccatggccaacctatcactctctccgagttggtgaaggcactttcaatccaccagatgaaatcagattacttgtaccgcctaatgcgcatattggttcactctgaattctttgccatacaaaaaattcatgaagatcaagaaggatatgtgctgacaccatcatccaagtatctcttgaagaatcaactgacaaacttgtcgccgtacatattaatggtgctagatcctgtcttagtaacaccttgtcatttcatgagtgcctggttccaagggaatgaatctacaccatttgaggtcgctcatgggatgagcttttgggaatactgtggccaacaccctgatatcagaaagtacttcaataaagcaatggctagtgatgcagaattggtgatgaccgtggcttctaaagagtgtaaaacgatgttcgaagggttcaaatcattggttgatgtagggggtgggacaggaacgatggccaaggctatttccaagtcattcccacacttgaaatgtactgtttttgatcttccctatatagtttcaaacttgcaaggaagcgaaaacatagaattcgtcggtggagacatgtttgagtctgtccctcctggagatatattcctactcaagttgattttgcacgattggaaggacgaagaatgtgtgaatatactaaagcgatgtagggaagcgatttcattagagaacaaaggaggaaaagtgattataatagacatgattgtggatgacaacagaggaaaatatgaatcaactgaagcacaactctgctttgacatgttgctgatggttttggtcactggaaaagagagaactgagagtgaatgggagaagctcttcctagaggctggttttactagttacaagataactcctgctttgggtctaaggtccttcattgaagtattcctgtag

SEQ ID NO: 655 - DNA, 1044 bp, Hydrastis canadensis
atggaaatcaacaaggaaaatctttcatctcaagctcaactctggaacttcatctatggttttgcagaatcactagttctcaaatcagctgtacaacttgatctagccaatataattcacaacaacaccaaacccatgactctctctgagttatcttcacatctaccgattcaaccagttaatcctgaccatttataccgaatcatgcgttacttagtccacatgaaactcttcactaaatcatcaattgatggtgaaattagatatgggcttgcaccaccagctaaatttcttgttaaaggttatgataaatgtatggttggttcaattttagcaatcacagataaagattttatggctccatggcattatcttaaggatggattatcaggtgaaagcggtacggctttcgaaaaggcattggggatgaatatatgggggtatatggcagaacaccctgaaaaaaatcagttgtttaatgaagcaatggctaatgatactagacttattatgtcagcattagtgaaagaatgcaaaagtatatttgaaggtgtaaatacacttgttgatgttggtgggggtactggaactgctgtgaggaatattgctaaagcatttccacatattaagtgtactgtttatgatcttcctcatgttattgctgattcccctggttactctgaagtcacttctttagaaggagatatgttcaagtatataccaaatgctgatgctatcatgatgaagtgcatccttcacgattgggacgacaacgaatgcatcgagattctaaagcgaagcaaagaggcagtacccaaagagggaggaaaagtaattataattgatatagtactaaatgtgcaatcagaacatccttacactaagatgagactgactttggatttagacatgatgctcaacactggaggaaaagagaggactgaagaagagtggaagaaactcatccatgccgcaggatttagtgggtataagataacacaaatttctgctgtacaatctgtgattgaagcttatccttattag

SEQ ID NO: 656 - DNA, 1068 bp, Hydrastis canadensis
atggagatcactgatggggttgaagggcatgagttacttgaagctcaagctcatatatggaaccatacattcaacttcataacctctatgacactcaaatgtgcagttcaattaggaataccagatattatctacaaccatggccaaccgatcactctctcagagttggtgaaggcgctttcaatccctcagacaaaatcggcctatttgtaccgcctcatgcacatgttggtgcactctggattctttgcggtacaaaaaattcatgaagatgaagaaggatatgtgttgacaccgtcatccaagattctaaagaagaatcacgtgacaagcttgtcaccggcgttattaatggttctagatcctgtcatggtaacgcctttccatttcatgagtacctggttccaagggactgaatccacagcatttgaagctgctcatgggaggagcttatggaattactgtggccagaatcctggcatgagtaagtgttttgatgaggcaatggctagcgattcagaattggtgatgagtgtggtggttaaagagtgtaagacgatgttcgaagggttgaggtcattggttgatgtagggggtggcacaggaactatggtcaagggtatttctgaggccttccctcacttgaaatgcacggtttttgatctacctcacgtagttgctgacatgaaagggaataaaaacatggaattcgtcgctggagacatgtttgagtatgtcccttctgcagatatactcctacttaagggtgttttgcatgactggagagacgaagaatgcgtgaatatactaaaacgatgcaaggaagcaatttcgtcaaaagacaagggaggaaaggtgattataatagacgtagtaatggatgacagcaaagaaaaatatgaatcaactgaaacacaactctgttttgatatgatgatgatggttatagtgtctggaaaagaaagatctgagattgaatgggagaaacttttcctagaggctggttttactagttacaagataactcctgttttgggtttaaggtccatcattgaagttttcccatag

SEQ ID NO: 657 - DNA, 1065 bp, Hydrastis canadensis
atggcactcattgaaggagaggaaattgatgttttgttgagtggtcaaaatcatctctggaaacacttactgaacttcatcaactccatgtccttaaaatgtgcaattcaattaggcataccagacattattcaccaccatggtcgacccattactcttttggaactagtttctgccctttcgttcccctcgagcaagaccgaatgtgttcatcgtttgttgcgcatgttggtgcactctggcttcattgataaacaaaaaaatggggacaaagaagatcaatattctcttactccctcttcaaaactcttggtgaaagaaaaccctatgaacttgtctccattagtgttgttgattttagacccatttattgtaacaccttttcactttctaagtacttggttttcaaaaactgaacctacaccctttgaaatggtacatggtgcaagtgtttgggaattagcaaggcaaaatattaagctgaacaatttcttcaatgacggtatggctagtgactctggctttttaatgagtatagctgtcaaagaatgtggtgaagtatttgacggattaacaacggtagtcgatgttggaggaggcactggtactgcagctaaggctattgccgaggccttcccacatgtaaaatgtaccatctttgatcttcctcatgtggttgctactttacccaaaaacatcatgataaattccattggaggtgatatgtttgaatccatcccctccacggacgccatttttctcaagtggattttacatgattggagtgacaaggactgcgtgaagatattgaaacaatgcaagaaagcgatttcttcttcagatggaggaaaggtgatcataatggacatagttatgaacaacaatgtgaaagatcaagaactcagtggaacacaaatttgtttcgatatgttgatgatgggtgtatgtggaggaaaagagcgtaatgaagaagaatggttcaaaatctttcttgatgctggttttactaggtataaaataagagcagttctaggtgtgcgatcgatcatcgaagtttacccatga

SEQ ID NO: 658 - DNA, 1071 bp, Hydrastis canadensis
atgcagatccaagaagaagaacaagagcaagagatgaaacatgaagcacaagtatggaaccacatgtctggtattgtagactcagtagttctcaaatgtgctatagagttaaacctctttgataccattaacaacaccacaaataatgaatccatcactctttcttcactaacaacttctctatccttaccttctatcaaaccccactacttataccgtttactaagatacttagctcacatgaaactcatcaccattcatgttacccaacaaaatgaaacattttcattaacagaattagccaaattacttgttaaagatgaagagaagaatttagttgattgggcaatgataattatcgaagtaaattcgattaatggttggcatcaattgagtgattattgttcttgttcaagtgatgagccaacaccatttgaaaaatctcatgaagggaagagtgtatggaagatagcaggggagaattcaaagatgaatcaactgattaatgatgctatggattgtgacactaaaatgtttatgccagcatttatgcaatgttgtgataagttcttgaatggagttacatcaatggtagacgttggcggcggtgtcggtgttgctatgagttttattgttaaggcttttactcgtatcaagtgtactgtttttgatctacctcatgttatagctgcagcaacggagtttcctggtgtggaatttgttgaaggtgacatgtttcaatccatcccacctactgatgctgtttttttgaagtttatgcttcataattggcaagatgaagaatgtgtgaagattcttaagaattgtaaagaagccattccaaaaaacaaagggaaggtgatcatcatagacattattattgatgaagatgaagatgattatcatttatcaagagcaaagatgaaccttgatattgacatgatggtaaactcaggaggtagggagaggactaaaaaggaatgggaacttctccttgaccttgctggctttagtgggcatgaaatagttcccattatggctatacaatcagttattgttgcatatccttag

SEQ ID NO: 659 - DNA, 1095 bp, Hydrastis canadensis
atgggttcaacccaaaaccaaatttttagcactcaagaagaggaagaggaagcatgtaatcatgcgatgcaattagccagtgcttcagtcttacccatggttttaaaagcagctgtagagctagatgtgctagagatcattgctaaagctggtaagggtgcgtatatcaccccttctgatatagcatctcaacttcccacaaacaacccagattctactgtgatgcttgatcgtatgctgcgtctacttgctagttataaggtacttaattgcactctgcgcactttagaggatggacgggtggagagatcgtatggtcttgcacctgtttgtaagttcttggttaagaatgaagatggtgtgtccatttgtcctttagtactcatgaatcaagataaggtcctcatggagagctggtaccatttgaaggatgcagtgcttgacggtggaattccatttaacaaggcatatggaatgagtgcattcgagtatcatggtacagatcccagatttaacaaggtattcaataagggaatgtcagatcactccaccataaccatgaagaagattcttgagatttataaggggtttcaaggcttgaaatcagtggtcgatgttggtggtggtattggtgctacagttaatatgatcgtttctaagcacccctcaattaaaggcattaattttgacttgcctcatgtcatccaagatgcaccctcttattcaggtgtacaacacattggaggagatatgtttgtaaccgttcctaatggagatgctatatttatgaaatggattcttcatgattggagcgatgaacattgtttgaagttattgaagaattgttacaaagcattgccaagtgatggaaaggtgattattgtggaggcgattcttccagtatttcctgaaactaatctggctgcaaacggtgtcttccaacttgataacatcatgcttgctcataatcctggaggaaaagagagaacagagaaggagttcgaggcattgtcttttggagcgggattcacttcctttcgtgttatctgttgtgcttttaacacttgggttatggagttctgtaaaaacatataa

SEQ ID NO: 660 - DNA, 1068 bp, Hydrastis canadensis
atggatgtccaagaaagtggtacaaattatctctcaggtttaggcttatctcgcttaatatgtcttccaatggcattaagagcagcaattgagctaaatgtattcgaaattatttctcaggctggatctaatgctcaactttcttcatcagaaatagtatccaaaatccccacaaaaaatcctaaagcatcaatttcgttagatcgaattcttcgaatgcttggtgcaagttccattctttctatttcaatgaacaaagatcatcaaagagtctatggactaacaaatgagtcacgttgcttagtagctaatgaagataaagtttctgtagtacccatgttgctctttacttcagataaagctgttgttgaaagcttttatttgattaaagatgttgttcttgaagaaggggttgttccatttgatagagctcatggtgtggatttctttgagtatgctggtaaggaacaaagagtgaacaagtcttttaatcaagcaatgggggctggatctactattgcttttgatgaagtgtttaaggtttataaaggttttgaggagttgaaggaattggttgatgttggaggtggtattgggacttcacttagtaatattgtttctaagtacccacatattcgcggtattaacttcgagttgcctcatgtcattgctgatgcacctaattatcctggtgtggagcatgtgtcgggagatatgtttgagggagtaccgaatgcacaaaacattttgctcaagtgggtacttcatgactgggatgatgaaagaagcataaagatactacagaattgttggaaagcattgcctgaatgtgggagggtgattgtagttgagtttgttcttcctcaaattctaggaaacaatgcagaatctttcaatgccttaactcctgatcttctcatgatggctttgaatcctggtggtaaagagaggacaactattgaatttggtcatctagctaaggaagcaggatttgctgaaacaaagttttttcccatttcacaaggccttcatgttatggaattccacaaaaaagctgctactagttaa

SEQ ID NO: 661 - DNA, 1092 bp, Hydrastis canadensis
atggaattccaaaaaatcaaaatcactgatggagttgatcaaacacaagacgatttcggatgcgttatgcaattcacaacatctgcagttcttcctatggcaatgagagctgtgattgagatgaacttattggagataatggcaaaagctggtccaaatgcacaactctcaccttcacaaattgcatctcaacttcaaacacaaaacccaaatgccccaatgatgttggatagaattttgagacttcttgctagttattctctagtcacatgttctactgtctcacatgaaaatggttcagttgaaaggttttatggtttggcacctaagtccaaagacttagttaaggatgaagatggagtttcaatgtctcctatgatgatgatgattttggataaagtttgcatggaaagctggtacaacttgaaagatgcgattctggatgggggtgttccatttatcaaagcacatggagtgaactcatgggaatacccaagcagggatccaagattcaatcatgtcttcaatatagcaatgtttaattacacagcaacagcaatgaagaagatccttgagatatataagggatttgaaggcttaaaagtattagtagatgttggtgggggcattggaacctcaattagcatgatcacttcaaagtatccagcaattaagggtataaacttcgatttaccccatgtaatccaacatgcaccatcctatccaggggttgaacatgtcggcggagatatgtttgtaagcattcccgaaggtgactcaattatgatgaaaggaatactacacgattggagtgatgaacaatgcataaaattattgaaaatgtgttatgaagtattacctgatcacgggaaggtgatcattgcggaaaggattcttccggtaaccattgaagatagtgtcgctgcaaaagacatcttccaattcgaccttatgatgttgacatttcatggtggtggaaaagaaagaacagaaaaagagttcaaaatcatgggaaaagaagctggattttctgataatgaaattgtatgtcatttgtttaactactgggtgatcatggaatttatcaaataa

SEQ ID NO: 662 - DNA, 1023 bp, Hydrastis canadensis
atgcacttgaccacatcttcagtacttcctatggtaatgaaaactgtgattgagcttgatttacttgagataatagcgaaagctggtctaggaaaacagatttcaccatcagagattgcttctcatcttcccactaaaaacccaaatgcatccatgatgttggatcgaattttgtgccttcttgctagctattctgtggtcacttgttctactatctctcatgaaaatggtgaagttgaaagattgtatggtttgggaccaatgagcagatatttggttaaagatgaagatggagtttctatgtctgctgcaatgatgattgttgtgaataagatctgcatggaaagttggtaccatttgaaagttgcagttttggatgggggaattccattcgaaaaggctcacggaattaatatgttccaataccaagacaatgacaaaggattcaaacagatattccaggattcaatgtctaattacactatcatggttatgaagaaaattcttcagacatacaaagggtttgaggatctgaaagaacttgttgatgttggtggtaacactgggtctgcaattagtatgatcacttctaagtatcctaaaattaagggtattaattttgatttacctcttgtgattgaacaagccccctcatatccaggggtcaaacatgtgggaggaaatatgttcacaggtgttcccaaaggagagaactttttcatgaaatgggtacttcataattggagtgacgaacattgcttgacattgttgaagaattgttacgaagcattacccagtaatggaaaggtgatcgtggtggagatgatggctccaacgtccattgaaactgatgattctgcgaaaagtttcttccagcttgaccttattatgatggtgcaacccggtcacgggaaggaaagaacattaaaagagtttgaaaccattgcaaaggaagctggatttgctagtattaaggttgtctgctgtgcttgtaacaactgggtcatggaattcactaaatga

SEQ ID NO: 663 - DNA, 1086 bp, Hydrastis canadensis
atgggttccataaaaaaccaactcaaaactgatgatgaaaatttttcattggtaatgcaattaataacttcttcaattctatctcatgggcttcaagtagcaattgagcttgatttgtttgaaatcatagctaaagcaggtccaaatgcaaaactctcccccagagatatagtgtctcacctatctactcaaaatccagatgcacccattatgcttgaccgtatcctacgccttctcgttagctactctatactcaattcctctattgtcaccaatcaagatggcctagttgaaagattgtatggtttgacacccgtcggcgaatattttgcccggaatgaagatggcgtttccatgtctccgatgatgctcttagggcacgacaaggtcttcaatgatagctggtactacttgaaagattcgattctagaagggggaattccatttaacaaggcccatgggatgcacgcatttgaataccctcggatagactcaagattcaatcacctcttcaacgatgcaatgttcaaccataccacaattatcatgaaaaagattgttgatacatacggtggatttgaggacctcaaagagctgattgatgtgggtggcggagttggaactacaattagcataatcacttcaaaatatcctacaattaggggcattaatttcgatttgccgcatgtaattgaacatgcaccaacctaccccggtgtagaaaatgttggaggagatatgtttgcaagtgttccgaagggtgaagccattttcttgaagtggatacttcatgattggagcggcgaatcttgtttaaaactattgaagaattgttacaaagcactacctaatcaagggaaattgatcattgttgaggcaattcttccagtagccacggagaatgataccgctgcaaaagggatatgccaaatggaccttgttatgatgacacaaaatccaggaggaaaagaaaggacagaagaagaatttgaatccatggcgaagggagctggttttgctggcatgaagaaagtgtgtcgtatttataactattgggtaattgagttctataaacacaaacattga

SEQ ID NO: 664 - DNA, 1065 bp, Hydrastis canadensis
atgacttccataaacaatggaaatcaactcaaaaccaccaatggacaagatgaagatttctcacacatcatgcaattcacaacagcttcagtccttcccatggctatgagagctgtaattgaaatggacttattggagattatagcaaaagctggtccaaatgcacaactctcaccttcacaaattgcatctcaccttcaaacaaaaaaccccgatgcaccagtgatgttggatcgaattttacgccttattgctagttattctctaatcacatgttcttctgtctcccatgaaaatggtccggtggaaaggttttatggtttggcacctatatctaaatactttgttaaggatgaggaggaagtttcagtgtctcctatgatattgatggttcttgataaagtctgcatggaaagttggttccatttgaaagatgctattcttgatggaggtgttccatttaaaaaagcacatggagtggactcatggaaatatacaggcatagaccaaaaattcaatcaagttttcaataaagcaatgttcaataacacatcattgatcatgaaaaaaattcttgagaaatacaacggatttgaaaatgtgaaaggagtagtcgacgttggtggaggaattggaactgcagttagcatcattacttcaaagtatcctgcaatcaagggtatcaacttcgacttaccccatgtcgtccaacatgctccatcctatcctggggttgaacatgttggaggagatatttttgtaagcattcccaaaggtgaagcaattttcatgaaaggtatctttcacgattggagtgatgaacactgcaagaaaatattgaagaattgttctgaagcattaccagaacatgggaaagtgattgttgtggagaggattcttccagtagtcctcgaaacaaatacagcggcgaaagatatcttccaattcgacttgatcatgatgacacaacatggtgttgggaaggaaagattagaaaaagaattcaaggccattgcaaaggaatctggatttacttgtaatattgtgtgtcgtctgttcaattat

SEQ ID NO: 665 - DNA, 1056 bp, Jeffersonia diphylla
atggaagtcaatggaaagactaatgaagctgtagacatcaaagctcaagctcatctatggaaaatcatctacggctttgccgattccctggtcctgcgatgcgctgtggagcttgggatagcagacatcattgataacaacaaccagcccatcacactctccgaccttgcatcaaagctcccacttcccagtgtcaatattgattacttgtatcgaatcatgcgttacttggttcacatgaaactattcaaagttgaggaaaatatcaatggtgtcaagcaatactcgctccaacccactggcactttgctcctaaggactgcagagaggaacatggttccaatggtccttgggatgactcaaaaggattttgtcaccccttggcacttcatgaaggatggtctaagcgacgatggcacagcctttgagaagggaatggggatgaccatatgggagtacctagaaggacatccggatcaaagccaactcttcaatgaaggcatggctggtgaaactaggcttctaacgtcgtctcttatatctggatgcggagacctttttaaaggtattacatctcttgtggatgttggaggaggaaatggtactactcttaaagggatatcagatgcatttcctcatatcaagtgcacactctttgatcttccttatgttattgctaactcttatgatcatccaaatatcgagcgcattgctggggatatgttccagtcagtaccaagtgcccaggccatcttacttaagctaattttgcacgactggagcgatgaggactgtattaagattctgaagaaatgcaaggaagcagtgccaaaagagggaggtaaagttataatagtcgacgtggcattggacgaggagtccgatcatgagcttactagcacgagattgatacttgatattgatatgttggtgaacaccggtggcaaagagaggactaaggaggactggaataagctcgttaaagctgcaggttttcgaggtttcaacatcaagcacattgcagctgttcagtcagtaattgaggtctttccataa

SEQ ID NO: 666 - DNA, 1056 bp, Jeffersonia diphylla
atggaagctaaaactgggtttgagatatcatcccaagcaaacctatggaacttcatctacggattctcaaactcactagtcctgagatgtgcagtagaactggatatagccaacatcattcacaaccatggaatgcctattacactatccgaattggagttactgcttccggtgcagcctgttaatacggccagcttgtaccgagttatgcgttacttggcacacatcaagatattcaccaaaacattggacgtagatggggagactagatacggacttacaccgtcggctaagttccttgttaaaggctgggatcaatgcacggtgggtgcaattttgggtatcactgataaggatttcatggccccatggcattacatcaaagatgggcttacaggtgacagtaagaagaccgctttcgagaaggcactaggaatggatatatggaaatacatgggggatcacccagaaaagaacaagctgtttaacgcagcaatggcatgcgattcgaggcttgctatgtcggcattgataaatgaatgcaaagataagttccaagagataacatccctggtggatgtaggtggaggcactggaactgctgccagaaacattgctcaggcttttccccatattaagtgcactgtctatgatctacctcatgtcattgctgactcccctgtctaccctgaacttaattctgttgccggtgacatgtttaagtgcgtcccaaatgccgacgccatcttcatgaagtgcatcctccatgattgggatgacaaggaatgtattgaaattttaaagcaatgtaaagaagcagttcccaaacaaggcgggaaagtcattatcgtcgacattgtactaaatatgaagtcagaccatccttacacaaaattgagactgactttagatttggacatgatgctaaacacgggtggaggcaaggagaggacagaggaggagtggaaaaaactattccaggctgcaggttttagaggatacaacatcactcaaatatctgcattgcaatctgtgatcgaggcttttccttattaa

SEQ ID NO: 667 - DNA, 1113 bp, Jeffersonia diphylla
atggcatcactgatggatagagagaccatagatggagatggaggtgagaaccttcttgaagcacaagctcatatattgaaccacttattcaacttcataagctccatgtcactcaagtgtgcagttcaactaggcataccagacatcatccacgaccatcataaccaacctattactctctctgaacttgtccaagcacttcaactccctaaggcaaactcggtgtttctgtatcgcctcatgcgtatattagtccattctggcttttttgcgagacaaaagatacatggaattcaagaggcacaagaagaagaagggtacatactgacaccttcatccaaactacttttaaaaggtcatccaatgagtgtatcaccattagtactattagttttggaccctgcccttgtaacaccttggcatgtcctaagtaattggttccagaggagtaatgagctgatcacaccttttgagggcgtaaacgggatgaacctttggaagtactgtggcgaaaaccaagagactgggaaattgtttgatgaggccatggcttgtgattcaaagttgctgatgagtgttgtgatgaaagagtgtaaggtgaagtttgaaggattgaggtcattggttgacgtaggcggaggtactggaacatcggttagagtcattgctgaagcctttccagccatgaagtgcaccgtattagacctaccacatgtggttggaaccttgcaagggacttcaaatttggagtttgttagtggagacatgtttgagttcatcccttctgcgcaggcaattcttttaaagtcgatcatgcatgattggagcgacgaagaatgtgtgaagatactaaatcgttgcagggaagtaattccatctaaagaggagggggggaaagtgatcattatagacatggtggtgaatgacaaaaacaaagggaactacgagtcaactgaaacacaactcggctttgacatgttgatgatggttttattgacaggaaaagagagaaccgagattgaatgggagaagctcttcttggattctggttttactagctacataataactcctatcctgggtttaaggtctttcattgaagtatttccctaa

SEQ ID NO: 668 - DNA, 1104 bp, Jeffersonia diphylla
atggcacaactgatggatagggagaccatagatggagatggaggtgagaagcttcttgaagcacaagctcacatatggaaccacgtattcaacttcataagctccatggcactgaagtgcgcagttcaactaggcatacctgacattatccatagccatcataacaaacccattactctttccgaactagttgaagcactctgtattcctaagactacgaccacatatgtctaccgtctcatgcgcatattagtccattctggtttctttgccacacaaaagatacatgtaactcaagaagcacaaggatacgtattaacaccatcttccaaactactactgaaggaccattgcatgagcatgtcgccgttcctactagcaatgttagatcctgtcttagtaactccatggcatttcctgagtgattggatccaaaagagtgatgagcttataacaccattcgagagtgcaaatggtaggaacttttggacgtattgtggtgagaaccgagagactgggaaactgtttgacgagtccatggctcgtgattgtgaattggtgatgagtgtcgtgctgaaagagtgtaaggagaagcttgagggaatgaggtcattggttgatgtagggggtggtacaggaactatgtgtagggttattgctgaagccttcccaggcgtaaagtgcactgtcttagatctagcgcatgtggttcaacccttacaagggagcgaaaatgtggagtttgttagtgggaacatgtttgagcatatcccttcagctgatgtagttctattgaagttgatcatgcatgattggagcgataatgaatgcgtgaagttactaaagcgatgcagggaagctgttctttcagaagaacaaggaggaaaagtagttataatagacatggtactggatgacaagaacgaagggaactatgagtcgaccaaaacaaaactcatctttgacatgttgatgatggtcttggtcacagggagggaaagaactgagattgaatggaagaaactctttttcgatgctggtttcagtggctacaagattacaccaattttgggattgaggtcattcattgaagtatttccttag

SEQ ID NO: 669 - DNA, 1074 bp, Jeffersonia diphylla
atggatagagagagcagtaattgggatgagggggaggagcttcttgaagcacaaactcacatattttaccacatattcaacttcataaactctttgtcacttaagtgtgcagttcaattgggaataccagatgtcatcgacaaccatcaacataaacctctcagtctatttgaactgggaaaagcacttaaaatcccacaagcaaaatctgcatatttgttccggcttatgcgcgtattagtacactctggttttttcgccacaaaaagaataaatggaagtaaagaagaaggttatctattaacaccttcatccaaattacttttgaaaaatcatcccatgagcatgtcacaatatttgctagtggtgttagaccctgtcttggtagcaccttgccatttttttagtgattggtttaggatgagtgatgaagtgatcacaccgtttgaggtcaggtggaagaagagcttatggagctattttggtgaaaaccaagtgatgggaaaattgtttgatgagtccatggcttgtgattcacggttggtgatgaatgttgtgttgaaaaagttcaagatgaagtttgaaggattgcagtcattggttgatgtagggggtggcgatggaactgcaagtaggatcatggttgaaacttttccagacatgaaatgcaccgtgttagatctaccacaagtggtcggaacatttcaagggagtgagaatttggagtttgttggcggagacatgtttcagtctatcccttctgctcatgcggtattcctaaagtggatcatacataattggaatgacgaggaatgcctgaagatactaaagcggtgcaaggacgcaattccatccaaaggagggaaactcatcataatagatattgtagttgatgaaaggagctataaatcaactcaatcacaactctatctagacatgctgatgatgattttgttgacaggaagagagagaactaagcttgaatgggagaagctcttctttaatgcagggttttctacttataacataactcctctatatgggttcaggtctttgattgaagtatatccctag

SEQ ID NO: 670 - DNA, 1041 bp, Jeffersonia diphylla
atggatacttgtaaccagagtcgagaagaggaaaacattagagctcaagcacaagtgtggaagcacatgtacggatttgccaatacaatcatgttacgatgcacacttcgccttgagctgcccgacataatccacaaacatggcccaatgacactttcggaattagcaagtaagctacctttcaaatccatcaaccttgatagatttaaccatatcatgaggtacctagtacacatgaaactctttacaatcgatacaggcaagactcatgaccaaaacaaatatagactaacccgagcatcagagcttcttgtaaaatctcatgagaagagtttggccccgttcgcaatgttgcaaactcatccccaagagttctctgtctggggacagtttattgaaaacttggatggaaccatgaagtacactgaagtgtaccatgatatggatcaagatcaggagataaataaattggtcaatgaggctatgactagccatactaagtgtatggtcccagctcttgtgtctgggttgatgaaggagaagatccttgatgacattaccacacttgtggatgtcgggggaagtgaaggtgttgcctcgttagcaatcatcgacgtggctccgcatataaagtgtgttattctggacttggttcatgttatagaaagtgtgcctaatgaccccaggttggaattcttgcctggtgacatgtttgcatttgtgccccaaagcaatgcagttctgttgaagtctattcttcataactatgacgatgagaactgcctcaagattttgggcaattgcaaggaagcagtatcctccacaggtggaaaggtcataatagtcgatatagtagttgatacagagaatttgccagagctctcttcagcaagattaagtttggacttggaaatgttgtgtatgggaggacaagaaaggaccaagcaagaatggaagtgtctcttgcataatgctgggtttagtcatcataacatagttcccatcgtggctatggaatccatcattgttgcctacccttag

SEQ ID NO: 671 - DNA, 1047 bp, Jeffersonia diphylla
atggatgaaaatcaggccaaggaagatgaagagatccaagctcaagttctcatatggaagtacatgtatggattcgcggagacagtgatgctcaggtgtgcgctactacttggtctcccggacataattcaccaacatggacccatgacattagcccaattggcaagcgaattgcctctaagttcggttgacatcaatcgcttccatcatgtaatgaggtacttagtccacatgaaattattcacaacaacgttccagaccaccggggaggaaacctacagcgcaaccgcagcatcagacctcctattgaaggaccatgaacagagcctgagctcatatgctatgttacaaactcaccctgaaacattttcgatgtggactcacataaatgagagcttagatggttcacaggcatattgggtttcaacctatggggcctcattgtatgataagatagagaatgagccggtccataagaagatggtaaacgatgcaatgaccagccacactaggtctatgagtcgagcccttgtctctgggttggcgaaggaacgacttcttgatggagtcaggtcacttgtggatgttggaggaaattcaggccaagctgctaaggccattaagggtagttttcctgatgtcaaatgtactgtcatggatttggcccatgttatagatagtgttgagcatgacccagacctggatttccttcccggtgatatgtttactatggtgcccaaagctgatgttattttagctaagtctatccttcacaattatgaggatgatgattgtctcaaaattttgaccaagtgcaaggaagccattcctgaaggaaaattgattcttgttgaaattgtacttgatgcaaaaaatttgcaagagttgtcttttgcaagactaggaatggacatggaaatgatttgtatgggaggcaaggaaagaaccaaacaagaatgggatgatctccttaaaaaagttgggttcagccaatacaagataataccaatgatggctattgaatcaatccttgtagcttatccttaa

SEQ ID NO: 672 - DNA, 1095 bp, Jeffersonia diphylla
atgggttcaacacaaaaccaaatcaaaatcacagatgcagaggaagatgaagcttgtaaccatgccatgcagctagcaagtgcttcagtccttcctatggtactcaaggctgcaatagagcttgacgttttagagatcattgctaaagctgggccaggcgcgtatgtttcgcctaaagaaatagcctcacaactccctaccactaacgcggatgcacctgttatgcttgaccgtatgctgagactccttgcaagctacaaggttctcacttgcactctgcgcagtttagaaaacgggcaggttgagaggttgtttggactagcacctgtgtgtaagttccttgtcaagaatgaagatggtgtttccatagctcctttggtgcttatgaatcaagataaagtcctcatggaaagctggtactacttgaaagatacagtacttgaaggtggcattccatttaacaaggcatatgggatgagtgcatttgagtaccatggcactgatcctagattcaataaggttttcaatagaggaatggctgatcactccaccataaccatgaagaaaattcttgaggtatacaagggatttgatggcttgaaatcattggttgatgttggtggtggaactggtgctattgtcaacatgattgtttctaaatacccttcccttaaaggaattaactttgatttgccccatgttgtcgacgatgcaccatcctatcctggtgttcaacatattggaggagatatgttcgtaagcattcccaaagcagatgcaatctttatgaagtggattcttcatgattggagtgacgaacacagcttgaagtttttgaaaaactgttatgaagcactgcccaaaaatgggaaggtcatcatcgctgaatcaattcttccagttttccctgagacaaaccttgcagcaaacggttgtttccaactagacaacatcatgttggctcataatcctggaggaaaagaaagaaccgaaaaagactttgaaacattggctaagggagctggctttgctagttttaaggttgtgtgtggtgcttataacacttgggtcatggagttctgtaaaaacatatga

SEQ ID NO: 673 - DNA, 1065 bp, Jeffersonia diphylla
atggatactaaaactggtgtgaactatctctcaggcttaggcttatcacgtctaatatgccttccaatggccctgagagctgccatagagctcaacgtatttgaaataatagcccaagctggtccagcagctcaactttcttcatcgcagatactcaaaaagatcccaacaaataacccaaatgcaacggttgccttggagcgaattctcagaatgttaggtgcaagtttaatcctatcagtatcgacgaacgcttcaaatgaaagagtttatggcttgacaagtgagtcaagttgtttggtgaccaagggtgaccaagtttcagtagtcccaatgttgctattcacagctgataaggctgttgtggagagcttttacatgcttaaagatgttgttcttgaagaaggatgtgtgccctttgataaagcacatggagttaacttttttgagtatgctgggaaggaaccaagggtgaataaactgtttaatcaagctatggctgttgggtctactattgcttttgatgaggtgtttaaggtttataaagggtttgatggaatgaaggagttggtggatgttggtggtgggattggaacttcccttagtaatattgtgtctaagtatcccaacattcgcggtattaattttgagttggcgcatgtcattgctgatgcacctaattttcctggtgtggagcatgttgcaggagatatgtttgaaagcttaccaagttctgaaaacattttgctcaagtgggtacttcatgattgggatgatgagcgatgcctgatgatactaaagagctgttggaaggcactgcctgagagtgggaaggtggttgtagttgagtttgttcttccacaaattttaggaaacaatgcggagtctttcaacgcattaactccagatatccttatgatggctttgaatccgggtggcaaggaacgaacaattgtggaatttagtgatctagctaaagcatcagggttcgatgaggtaaagccgtttccaatttcacaaggtcttcatgtcattgaatttcacaaaacgaagagtaatacttag

SEQ ID NO: 674 - DNA, 1077 bp, Jeffersonia diphylla
atgggttcacaggataacaagctcattgctaccatggaagaggacgatttctcacccagtttgtggttgacaacagcgtcggtgatgccaatggtgatgcgagctgtggtagagttggatgtgcttgagatcatagcaaaaggtggtcaggtcacctctttgcagatagcatcagagcttccaactcaaaaccccgaggctcccatgatgcttgaacgcattctgagactgctcgcaagctactctattctcacatgcactagtgccaccagtgaagatggcagtgttgaaagaatgtatggtgtagggcctgcttgcaaatacttcttgagaaaccaggatggagtatccatgtctcctatggtgttgatggctctggacaaggttttcacagaaagctggtatcacttgaaagatgcaattcttgatggcgggattgcattcaacaaggggcatggaatgtcttcattcgaatatacaggcacagatcaaaggttcaatcgtatcttcaatgttgcaatgtacaactacagtagcatagtcatgaagaaggtagtggagatatacaagggatttgatgaccttaaggaagtgatcgatgttgggggcggaataggaaccgccattagcatcatcacttcaaagtaccctaatattaggggtattaactttgacttgccacacgttattgaacatgcacccccaagtcctggggtggagcacattggcggggatatgttttcaagtgttcccaaggcaaacaacattttcatgaaaggcattcttcatgatgtgagcaatgaacgatgcttaactctgttgaagaattgttacgatgcattgccaaataatgggaaagtgattgccttggaaatgattgttccaaaagaaatagaaagtaatccaactgtgcaaaacatctttcattttgaccttatcatgatggtacaacactatggcaaagagagaacagagaaggagttggagcttattgcaaaggaagctggatttgctaaaatcaaactagtgtgtcgtgttttcatttattgggtcatcgaaatgataaagatgacctga

SEQ ID NO: 675 - DNA, 1053 bp, Mahonia aquifolium
atggagttgaatgggaaggatgagtctgtagacatcaaagcacaagctcatctatggaagatcatatatggctccgccgattcccttgtcctccgatgtgcagtagagcttgggatagcagacatcatcaatgacaacaaccaacccatcacactccctgaccttgcatccaaactcccactctccaatgtgaatattgatcacttgtaccgaattcttcggttcttagcccacatgaagttgatcaaacaagaggagaaacaaggcgttacgctttactcacttgaaccaattggaacattgttggtaaggaatgcaaagagaaacatggttccaataatccttggaatgacccaaaaggacttcatgacttcatggcatttcatgaaggatggtttgagcaacgacgggacaaccgcctttgagaaggggatggggatgactatatgggagtatcttgaaaggcacccagagcagagccaattgttcaatgaagggatggctggtgaaactaggcttcttacctcttcactcatcaatgggtgtagagacatgtttaaaggtattaattctcttgtggatgttggaggaggaaatgggactaccattaaggccatatctgatgcttttcctcatattaagtgcacactatatgacctttctcatgtcgtggccaactcttatgatcttcctaatgtcgaacgcattcctggggacatgtttcaatctgtgcctagtgcccaggctatcttgctcaagctgattttgcatgactggagcgatgaggactgcatcaagatcctaaaaaaatgcaaggaagcagtgccaaaagagggagggaaagtgataatagtggatgtggcattggatgagacgtcagatcacgagcttaccggcacaagattgatccttgatatagacatgttggtgaacactggtggtaaagagagaagcaaggaagattgggacaaactcgtcaaagctgcaggttttaaaggcttcaacatcaggcacattgcagcagttcagtctgtgattgaagtcttcccttag

SEQ ID NO: 676 - DNA, 1050 bp, Mahonia aquifolium
atgggggaagaaaacatagccaaccaagctaaattatggaatatcatctatggctttgcagactcacttgtgctaagatgtgcagtagagctcgatattgctaatatcattcacaaccatggaaagtccatgacactctctgaactggcttcagtgcttccggtgaaacaacctgttaattcggatagcttataccgagtaatgcgttacttggcacacttaagggtcttcactaagacattggacgcagatggagaaaccagatatgggctcgcaccaccggcaaattttttggttagagggaatgataattgcatggttggctcactgatggggcttactgataaggaattcatggctccgtggcactacatcaaagatggtctgtcaggtgatgatggtaagactgcttttgaaaaagcattaggaatggatatatgggaatacatgggagagaacccagagaagaacaagttgttcaatgaagcaatggcatgtgacacgagactcgtattgtctgccttgatcaacgaatgcaaggacaaattccaagggttaaattctctggttgatgttggtggtggcactggaactgctgcccggaaccttgccaaggcattcccacatttgaagtgcacggcttatgatctacctcatgtcattgctgactcccctgtttaccctgaaatcactcaagtcccaggcgacatgtttaaggtcataccatatgctgatgccatcctgatgaagtgtatccttcatgactggggtgataaagagtgcattcaaatcgtaaagaaatgcaaagaagcactgcccaaagaaggtggaaaggttattatcgtcgacattgtactagatgtgaaatcagaacatccttacacaaagttgagacttactttggatgtagacatgatgctcaacactggtggagggaaagagaggactgaagaggagtggaagaaactcatccaagctgctggtttcaaaagctataacatcactcaaatatctgctctacaatcggtgattgaggcgtttccttattaa

SEQ ID NO: 677 - DNA, 1038 bp, Mahonia aquifolium
atggaggccttgaatggctgcacaaatcattttgaagatgatgaagacctgagtgcacaagctctagtatggaaccatatgtatggtttcgccaatacaatcatgttaaggtgcacccttcgtcttaagcttcccgacataattcacaaggaaggaccactgacgttgtctcagttagcgagtaagctgcctttcaattctatcaatctcgatcgattcaaccacatcatgaggtacttagtgcacatgaaactctttaagatcgtcaataaagacaagtacgctctaacacgagcatcggagcttcttgtgaaatcgcacgaaaagagcttggccccgttcgcgatgttgcaaactcatccccaagagttcacttactggggacattttatcgaaaatcttgataaggccaagaactacactgaattgtaccatgaaatggacaatgatcctgagatcaataagctagtcaatgaggccatgactagccataccaagtgtatggtgccggccctcgtttctggcttgaccaaggagaatgtcttggctgatgtcaaatcgctcatcgatgttggaggaagtgaaggtattgcatcaaaggcgatcatcgatgttgtttcacatgtcaagtgtattattatggatttggctcatgttattgacactgtgcctaaggaccccagactggatttcttggctggtgacatgtttgattttgtccccaaagctgatgcagttatgctcaagtctattctccacaactatgatgatgacaactgcctcaagatcttaaccaagtgcaaggaagctatacctacaaaaggaggaaaggtgataatagtagaaattgtaattgacacacagaatttgccagagttctcttctgcaagattggggttggacatggagatgatttgcatgggaggacaagaaaggaccaaacaagaatgggcaactctcttgcacaaagctggatttgatcatcataccatcattcctataagggctattgaatctattattgtggcctgcccttag

SEQ ID NO: 678 - DNA, 1092 bp, Mahonia aquifolium
atgggttcaaccacccacatcccaatcaaaatcacagctcaagaggaagatgaagcttgcaaccatgccatgcaattggcaagtgcttcagtcctccctatggtcttgaaagcagcaattgagcttgatgtgcttgaaatcattgctaaagctggtcctggtgcctacatcagccctgctgaaattgtatcacaactctccactactaacccagatgcccttgtcatgcttgatcgtatgttgcgtctccttgctagttacaaggtggtgacttgcactctcaaaacttctgagggtggagaagttgagaggttgtatggtttggcccctgtgtgcaaattcttagtcaagaatgaagatggtgtctcaattgctccattggttctcatgaatcaagataaggtcctcatggaaagctggtaccacttaaaagatacagttttagatggtggcattccattcaacagggcatatggaatgacagcatttgagtaccatggcacagaccctaggttcaacaaggtcttcaacaagggaatggctgatcactcaaccataaccatgaaaaagattctcgaggtctacaccggattcgatggtttgaaatcactggttgatgttgggggtggtactggtgctataattaacactatcatttctaaatacccatcgattaaaggcattaactttgatttgcctcacgttatcggagatgcaccatcatatcctggtgttgagcatgttgggggagatatgtttgtcagtgtcccaaaagcagatgccatatttatgaagtggattcttcatgactggagcgatgagcatagcttgaagtttttgcaaaattgttacaatgcattaccatcagatggaaaggtgattatcgcagaatcaattcttccagtgtttccagagacagatctcgccgcaaatggtgttttccagcttgacaacatcatgctggctcataatccaggaggcaaagagaggacagaaaaagattttgaaggcttggcaaagaaggccggattttctggtttcaaagttgtatgtcgtgcttatggcacttacatcatggagttctctaaatag

SEQ ID NO: 679 - DNA, 1149 bp, Mahonia aquifolium
atgtctctctttagcaggtatgcaccccaacttgcaacctccaatcatatccataaccaaagccaaactacactcacaatggctactcaagagagtcctagctatctctcaggtttaggcctatcacgcttaatctgccttccaatggcactaagagcagcaatcgagctcaacgtgttcgaaatcatatcccaagctggtccaaaagcgcaactttcttcatcacaaatcctcacaaaaatccccacaaagaaccccaatggagcgatagccatagagcgcattcttagactgttgggtgcaagttcaatcctctcagtctccacaaactcatcaaaccaaagagtttatggcctaacaaatgagtcccttactttggtgcccagagctgaccaagtttctgtggtgcctatgttgctcttcacagctgataaggctgttgttgagagcttttacatgcttaaggatgtcgtcctcgacgaaccagggtgtataccatttgataagactcatgggatgaatttttttgagtatgctgggaaggagcctagagtgaacaaggtgtttaatcaagctatggctgttgggtctactattgcttttgatgaagtctttaaggtgtacaataaagggtttgatgggatgaaagagttggttgatgttggaggtggaattggaacctcccttagtagtattgtggctaagtatccacatattaggggcattaactttgagttggatcatgttattgctgatgcacctacttatcccggtgtggaacatattgcaggaaatatgtttgaaggggtaccaagtgcacaaaacattatgctcaagtgggtacttcatgactggggcgatgagcaaggccttattatactaaaaaactgttggaaggcactgccagagaatggaaaggtgattgtgattgagtttgttcttcctgaagttttgggaaacaatgctgaatccttcaatgcattgacgcctgatctgctcatgatggcgttgaatcctggtggtaaagagagaactattgttgaattcagtgagcttgcaaaggcggctgggtttgaagaagtgaagcctttcccaatctcacagggtctccatgtaattgaattccacaaaacaaaagcttgtgcttga

SEQ ID NO: 680 - DNA, 1068 bp, Menispermum canadense
atgatcttggacaaccatgacaaagcagaagaagctttagtagtggatgtccatgaccaagcacacctatggaagctcatctatggctttgtggacaccttagttgttagatcagcagtagagcttggaatcatggacatcatctacaacaacaagaagcccatctcgctcttcgatctcgcctcgaagctccctgtctccaacacctgtccggaccgattgtaccgcatacttcggtacttggttcacgttcgccttctcagagtggcagaggtcgacggcttgaaaaagtacttgctcgctcctgctgcgaaattgctacttaggaacactgagaagagcatggtgcccatcattctaggcatgacccaaaaggattttgtggtgccatggcatcacataaacgatggtttggggagtgagggtgccaccgccttcgataagtccatgggaatgtccttctttgagtacttagaagagaatcctagccagagcaagctcttcaatgaagccatggctggtgagactaggctgttaacagcttctcttatcaatggttgcaaagacttgtttcaaggtattgagtctttggtggatgttggaggagggaatggcacaaccattaaggccatatctgattcttttcctcatatcaagtgtaccctcttcgacctaccgtacgttgttgcagattctcacgacgaccctaatatcaagcgcgtccatggtgacatgttcaagtccatccctagttcccaagccatcttgctcaagttgattttgcatgattggagtgacgaagattgtgtgaagattctaaagcgatgcaaggaagctgtgcctaaggaaggagggaaggtgataatagtagatgtagcactggatgaggagtctcagcatgagttgagtagcacaagattgatacttgacatagatatgttggtcaacactggaggcaaggagaggagcaaagaggactgggagaagcttatcaaatgtgcaggatttggagggtacaaaattaggcacattgctgctattcagtcagtcatagaggtcttcccatag

SEQ ID NO: 681 - DNA, 1050 bp, Menispermum canadense
atggacaccaccattaatggaagcttattagaagctgatcacaatctccaagtcaaagctcaggctcatgtatggaacaccatctacagattctcagattctctcatcctccgcgccgtcatcgatctcggcattctcgacatcatcaacagcaacaacaacagcatttcgctctctgagctcgcctcgaagctccctctccaccacgtccaccacgaccacatcagccgcatcctccgccacctgacccacatgaaaatcttacgagtggtcaccgctgacgacgacggagatgataacatgatcaccaagtactcacttgagcctctagtggcggcgctgctgcttaagagctcggagaagagcttggcatataatgtactaggcatgattcaaaaggagtttgttctcccatggcactacattaaggattgtttagtgggctgtgatgagagtacaatatttactactccttttgagaaggccatgggagtgacgttttgggagtacttggagggccatttggaggatagcaagaactttaatgagtcaatggcgagtgagactcggcttctcacggcttcgctgatcgacggctgccgggatgtttttgagagtgttgggtcaattgttgatgttggaggagggaatgggacgactttgaaggcgatttccaatgagtttccgcatatcaagtgtactctgtttgatctcccttacgtggtggctaatgcttgtgattgtccggggattgagtgtgtctccggcgacatgttcaaagccatacccagtgctcaggccatcttattgaagttgatattgcacgactggggggacgaggactgtgtgaagattctaaagagatgcaaagaagcagtgcctagcgatgtgggcaaagtgatcatagttgatgtagcattagaagaggactttgaagacgagctcactggagcaagattagctctagacatggacatgttagtgaccacaggaggcaaagagaggaccaaagaagactgggagaagcttgtgaagcgtgcagggtttcgt

SEQ ID NO: 682 - DNA, 1071 bp, Menispermum canadense
atggaagcaccttcaactctaaagcaagaccaagcagcccaagccaagctttggaagttcatctatggctttgcagagtcactagtcctcaaatgtgccattcaacttgacatcccagacatcattcacagccatggccagcccatgaccctcacccacctcgcttcccggattccatcgagccaatccgtcgatgacgaccgcttgtatcgaatcatgcggtacttagtacacatgaagctcttcaccaaagagtccggcggcgacgacggcgaagaccgatatgggcttgcaccaccagccaagtacctagtgaaggggtgggagaagagcatggtgccctcaatcctctgcattactgataaggacttcatgtctccatggcaccacctcaaacaaggcttggtcgacgacgacgagggcaatcatcggactgccttcgagaaggcgttgggagtgaacatttgggactacatgtcggagaacccaaagaagaacaagttgttcaatgaagccatggcttgtgacactaggcttatcatgtctgcattggtgaatgagtgcaaggaggtgttcgaaggggtccagtcgctagtggacattggtggcggcaccggaactgctgttagaaacattgccaaggccttccctcacatacattgcactgtttatgatctccctcatgttgctgctgattctccttcttatcctgaagtgactcgcgtcgaaggcgacatgtttaagtacattccaagcgcggatgccatcctaatgaagtgcattcttcacgattgggccgacaaggaatgcattcagattctgaagaagtgcaaggaagcattgccgatagatggagggaaggtgatcatcgtcgatatcgtgctaaatgcgaagtcagagcatccatactcgaagatgaggatggtgatggacttggacatgatgctcaactgtggagggaaggagagaacagaggaggagtggaagaaacttatatatggagctggttttagtagatacaatatcaggcaagtcaatgcattacagtctgtgattgaggtttacccttga

SEQ ID NO: 683 - DNA, 1044 bp, Menispermum canadense
atggaagccgagaagtatgagcgatcagcccaagccacagtgtggaacttcatctacggctacactgaaacactagtcctcaaatgcgcagttcagctggacatccccaccataattcacaaccatggcaagcccatgtccatctctcaattatcttcacacctaccaaatcaacccatcgatcaagaccgcttgtaccgcataatgcgctacttggtgcacttgaagttcttcaccaaatggctcatagaaggcgagacaagatttgggctcgcaccaccagccaagtttctcatcaaaggatgggacaagagcatggttcctattgtattagccatgacagacaagaattacatggcctcatggcactatgttaaagaaggcttggttggtgacaaagtggctctagagaaggcactggggatgggcatttgggactacatggctgatcatcctgagatgagccaaaggttcaatgaagccatggcatctgacactaggctcgtcacttcagcgttggtgagcgaagaatgcaagggagtgttcgaagggatagcatcgctggtggacgttggtggcggcacagggaccgcgttgaggagcattgctaaggccttcccaaatgttaagtgcactctgtatgatcttcctcatgtgatatccaactctcctaggtaccctgaaatcagttgtgtggaaggggacatgtttaagtacataccaagggcagatgctgtcctaatgaagtgcatccttcatgactggggggacaaagaatgcatagagattctaaagcgatgcaaagaagcagtgcctcgagatggagggaaagtgatcatcgtcgacattgtaattgacacgcagtcaactcatccttacaccaagatgaggcttacatcagatttggatatgatgcttaacactggaggcaaagagagaagtgaagaagaatggaagaatctcatccttgctgcaggctacagtggatacaatatcacacagatatcagcagtgccttcagtcatcgaagcctttccctattag

SEQ ID NO: 684 - DNA, 1071 bp, Menispermum canadense
atggcagaggaggcagtgcgagagcaggaagagactctgcgcggccaagcagaaatctgggagtgcatgttctcattcgcagagtccatggcgctacggtgcgccctggagctccgaatacccgagataataaactcccacggccgtccgatgacgatatcacagatcacaaagaaaataatcaactctccctcccaaccggaccccaactgcctatctcgcatcatgcggcttctggtccgcaaacgtgtcttcaccgcagctgcggccggacaggaagtcgtgtacggcctcacccggtcgtccaagtggctcctgcgcgactcggagtcggagctgagcctggcgcctatggcgctgatggagacgcacccgcagctgatggctccgtggcattggttcggtaaatgcgtggaggagggcggagtggcgtttgaaaaggcgcacggctcggagatatgggacttcgcttcggtgcaaccggagttcaataaccttttcaaccggggcatggagtgcacggccaagattgtggttaaggcggtgttggaggggtatagagaggggtttgatgggttggagacggtggtggatgttggaggtgggactgggatgatgataagggagatcgtgacggagcatccgcacttgaagggtataaattttgatcttccgcacgtagttgccaccgcaccggatcatcccaacgtcgtgcacgttggtggcgacatgttcgtggaagttccacgtgcagacgctgtggtcatgaagtggataatgcatgattggagtgatgaagattgcatccaaatcttgaagaactgtcgcaagtcgataccagagaaaagtgggaaggtgataatagtggatgcggtgttgcggccagaaggcgatggcttgtttgactacacaggactagtgttagatttgctgatgatcgcacacagctctggtggaaaggaaagaacagaagaggaatggaaggcgctcttaaaagctggaggcttccctcgctacaaaatcatccaaatcccaactctaccatccattatcgaggcctatccactgtga

SEQ ID NO: 685 - DNA, 1026 bp, Menispermum canadense
atggaggaagaaatgaaggctcaagggcaggtgtggagatatgtgtacggcttcgccgagtcaatgactctgaaatgcgcgattcaactcgggatccccgacatcctccaccagcacggccgccccatgactctctccgagttagctgactcactgcccctccccaccgtgaaccaggaccgattgttccgagtcatgcgctacctagtacacatgggcctcttcgacctagtcgactcggacaaaaaatacgctctcaaccccgcctcaaacctcctcatcaaaggccaggacaagagcctcgcctcctttgccctcctccagtactacgagatggacgcgtggcaccacctcagcgccgccgtggaaggcgacgtcacgccgtgggagaagtgccacggcgtggactaccgagagtacttcgcgaaggactcggtggcgaaccagctgctgagcgacgccatgacgagtcacaccagcatggtgaccgaggcgctcgtggagggctgtaagaaggcgaaggtgctcgatggggtcggctcgttcgtcgatgtcggcggcagcaccggcgtcgccgctcgcgccatagctaaagctttccccggcgtcaaatgcgccgtgtttgatctccctcacgtgatcgccaccgcacccgagtgcgccgatgtggaccggatcgaaggcgacatgttcgtctccgtgcctgagaccgacgtggtcttcatgaagtcggtgttgcacgattggggagatgaggactgtgtgaagattctgaagaagtgcaaagaagcgattggagggagaaaagaggggaaagtggtgatattggacatagtgttggatgcagagtcgagttatgagtttaagggagcgaggttggggatggagatggacatgttggtgacggtgggagggaaggagaggagcgaggaggagtggcagaagctgttcaaagctgcggggtacagtcggtacaagatcacgcccatcgtggccattgaatccatcatcgaagtcttcccttaa

SEQ ID NO: 686 - DNA, 1110 bp, Menispermum canadense
atgatgaatatgagtgaaagaaacccaaaagatgaagaagaagaaggtaagaaagaagagatcattaaagggcaggctcagttgtggaagcacatgtacgggtttctagacacgatcgtgcttaggtgcgcggttcagctcgggataccagacctgattcatgagcaaggtcccatgacactgcacgagcttgcaaacaaactgccaatcgataccataaatatgcaaagatttcatcaaaccatgaggtacatggtgcacatgaatctcttcactgttatgatggcaaaagacgacgaagtcatggtcactaaatatgggctcactcctgcatcaaagctgctcctaaaacatgataataacaacaacaacaagattagcatggcctcgtatgtgatgttgcagacagagccacatgagttttccatggctgagaagctagttgaaagcttgggatcaggaacaaagacatgctgggatttgttttatgggattgttccctatgagaagatggaggaggaccctgaatcgaccaagatgatgattgatgcaatgaccagttctaccacgtgcatggttcaagctctagttgaggggttgatgagggagaatgttcttgaagatgttacatcactcgtggatgtaggaggaaacactggtgatgtggctaaggcaatattgagtgcattcccacatttaaagtgcactgttatggacttgctttatgttattcagagtgttcccaaggttcctcaactggattttgtggctggtgacatgtttcattctattccccacgctgatgttgttttattgaagtctgttctgcataactatgaagatgatacgtgcatcaagattttgaacaagtgcaaggaagcaataggtccaacaagggggaaggtgatactggttgagattgtagttgacattgaaaacatgccagagttctccgctgcaagattgggtttggaaatggacatgatgtttatgggtggaaaagaaagaaccaagaaagattgggaaaacctcttctacaacgctggatatagctaccacaggataatacctattgcagctgttgaatcgattatcgtggtttatctatag

SEQ ID NO: 687 - DNA, 1071 bp, Menispermum canadense
atggcagggaagcaagacggcggtgtgaactacctcggagggctaggcctgggccgtctgatcgccctcccaatggctctaagagcagcgatcgagctcaacgtcttccaaatcatctccgacgccgggcctgaggcccacctctccccatcagaaatcgtcgcaaaaatccccacaaccaaccccaacgcgcccactgccctggaccgaatcctcagaatgctgggcgcgagcgcgcttctctcggtcactgtgcgcgcgccgtccggagaccgagcctacgggctcacgagcgagtcgctgagcctggtgcccaacaaggagggcgtgtcggctgtgccgatgctgctcttggtgtcggaccaggccgtggtgaagagcttttttgggctcaaacacgcggtgcttgaagaggggtgcgtgccgttcgataagttgcatgggatgaatttctttgagtatgcggggcaggaaccgagagtgaaccaggtgtttaatgacgctatggcggttagttccactatctcgtttgatgaggtgtataaggtgtataaggggtttgatgaggttagggagttggttgatgtgggtgggggtttggggacctcgcttagtagtattgtgtgcaaatatccgaagattagtgggattaatttcgacttgagccatgttattgctgatgcaccaccttatccaggtgtgaagcatgttgcgggagatatgtttgagggcatacccagcgcgcaaaatattctgctcaagtgggtacttcacgactggggcgatgagtactgcgcgaagatattgaagaactgtttccaagctctgccagacggtgggaaggtgattgtggtggagtttgtgctgccttcggtgcttggaaacaatgttgagactttcaacgcattgattcctgatctcattatgttgaacttgaatcccggaggcaaagagcggactatcgtccaatatgaggatcttgcaagagcagcagggttttcggaattcaagccttttccaatctcacaaggccttcatgtcttggaattcttaaagaagggctcaaattaa

SEQ ID NO: 688 - DNA, 1113 bp, Menispermum canadense
atggattccacagagcattgccaggcgaaacccagcaacgaagacgaagatttcttgtttgcgatgcaactggtcaacgcttcggtgctaccgatggtgatgcgagcagctattaatctcgacgtgttcgagatcatcaacagatacggcaaagattcgcgtctctcagcatctcaaatcgcgtctcgaatgacatcgcatcatcacccacaaacgcccgttatgctcgatcgtttgttgcgtcttctcgctagctactctgtgctcacttgctctgttaatgttgcaaatcaagagagcgatgatgatcaggttattgaaacgctgtatggtttgacacctgcttgcaagtatttcgttaagaacgaagatgggttctcactttctccttacttgatctatgcccaagacaaggtctcattggacagctggtaccagttggatgatgcagttgttaaagggggattttcatttgacaaggttcatggaatgggccaattccagttgttaggaaaagagcccagaatgaatgagctcttcaatagagcaatgtccaaccacacaaccattgtgatgaacaagattcttgagagatacaaggggtttgagggcctaaaagtggtgattgatgtgggtggtgggactggaaccaacacaaatattattgtatccaagtaccctacagttaagggcatcaatttcgacttgcctcatgtgattcaaagcgccccatcctaccctggtgttgaacatgttggaggagatatgtttgaatgtgttccaaagggagatgccattttcatgaagtggatacttcataattggagtgatgagcgctgcttggcattgttaaagaagtgttatgaagccctaccagatgaaggaaaggtgattgttgtagaggggattcttccagcagttccagaggctaatactgctaatgaagttgtgtatcagatggacctgataatgatgacaaagcactcaggagggaaggagaggacagtagaggagtttgaggccctggccaaagcatctggatttgctggtcttaggctaatatgctgtgcctataactattgggtcatggaatactacaaatctgtaatttaa

SEQ ID NO: 689 - DNA, 1086 bp, Menispermum canadense
atgcacatggaagagcaggatcaagatcaagagatgcaatggcaagcccaagtgtggaaccatgtagcgggaggcttcgttgactccatcgtcctcaagtgcgctgccgacctcgccatcttcgacgccattcacaacatccaaaccaaacaaaccaaaccagtcgctctctccgcactcacttctcacttctcctccatcaacacccaaaagctgtaccgccttctaaggtacttggctcacatgaaactcctcaccatcacccaatcaccatttgatgataatgaagaatatgagatcacagtatcaatcacagagctagccaagttcttattcagacacaatgagaagaacatggtggactgggcacttggggtccccgaccagcccgcggtggttgcttggcaccagctcagcaattgcatcgcaagcgaagagccggcgcccttcaagaaggagcacgggaagagcttgtgggagtttgcaagggacaacccggagatgaacaaggtgttcaacgacgccatggcatgcgatacaaggttggtgatgcctgcgtttgttgagggttgcaaggagattttgaagggggttggatcgttggttgatgttggtggtggcaccggaactgctatgagttatgttgttaaggctttccctcatgtcaagtgcacagtgtttgaccttcctcatgttataaggacgtctccggagtatccaggagtagaactggttggaggagacatgtttcagtctgttcctcacgcagatgttgttttgttgaagtttatgctccataactggcaaaatgagggctgtgtgaaaatactaaagaaatgcaaggaagcagtactcccaagtgagaaagggaaggtgattatagtagatgttgtgatagaccaagatgaagaagatgatgatctaacacatgtgaggctaagtttggatatggacatgatggcaatgtcaggaggcagggagagaactaaggaggaatggagagtgctaatggaaatggcagggtttagtgggtatgagtttattcccatttatgccatgcaatcagtcattgtggcatatccttaa

SEQ ID NO: 690 - DNA, 1104 bp, Menispermum canadense
atgggttcaacccaaaaccaattagccgcgatgaccctctcggccgaagacgaagaagaagcgtgcatgtacgcgatgcagctggccagcgcctctgtgcttccgatggtgctgaaagctgccatcgagctcgatgtgctggagatcatcgccaaagccgggccgggtgcccacgtggctccgtcgcagatcgtggcccagctaccgaactgcaccaaccctcaggccgccgtgatgctggaccgaactttaaggctattggcgagcttcaggatcctgacttgcaagcttgatgagggcggggagagagtggagaggacgtatgggcttgggcctgtgtgtaagttcttggtgaagaacgaggatggcgtgtccatggcgcctctggtgctcatgaaccaggacaaggttctcatggagagctggtatcacttgaaggatgcaattcttgatggtggaatcccattcaacaaggcctatggcatgaccgcgtttgagtaccatggaacagatccaaggttcaacaaggtcttcaacaggggaatgtcagatcactccaccattaccatgaagaagctgcttgagacatacaaaggctttgatggcctgaaatcagtggtcgatgtcggcggagggatcggagcaactctcaacatgatcatctccaagcaccccaccattaaaggcattaactttgatttgcctcatgtcattgaagatgcaccttcttatcctggtgttgagcatgttggaggagacatgtttgtgagcgttccaaagggagatgccattttcatgaagtggattctccacgattggagcgacggacattgtgcaaaatttttgaagaactgccatgaagcactgccagatgatgggaaggtgatcattgtggaatcaattctcccagagttcccagagacaaatcttgctgctaatggtagcttccaacttgacaacatcatgttggcccacaaccctggagggaaagagaggactgcgaaagatttcgaggccttggcgaagggagccggctttgttggctttaatgttgtgtgtggtgcttacaacagctgggtcatggagttctgtaaaaagctgtga

SEQ ID NO: 691 - DNA, 1047 bp, Menispermum canadense
atggaagacagctctgcatttaaagtcatggagctgctgggcctaggccctctccaaatgtccctaaaagctgcaatagagctcaaagtgctagagattcttcacaaggctgggcctgaatcaaagctctcagcttctcaaattgctgctcagctacccaccacaaatccaactgcctccacagcacttgataggattctaagtctactagcaagtaattcaattctaagtagtacaacagctggagaaaatggagagagattgtatggattgacacccatttgtaagtactttgtatctaatcaagatggtgcgtcactggcaccactgttccttttcttccatgacaaggtgctgatggagagcttgagcaatctgaaagactgtgtcctagaaggctctgttccctttgacaaggcctttggaatgaacatttttgattacttgggtgcggatgagaggttcagaaaggtgtttagctttggactttctaatcattcaatcactgtaatgagagatcttcttgagaattacaaagggtttgagggtgtgaaagaagtcgtggatgtcggtggagggattggggcatcgttgaagatgattgtttcaaagtatcctcatataaagggtaccaattttgatctccctcatgtgattgctgatgcaccttcttacccaggtgtgaagcatgtctctggtgatatgtttgaaagggtacctaattgtgatgcaatatttatgaagttcattttccacgcatgggatgacaaacactgcgaggtcctactgaagaactgttggaatgcattgcctgagcatggaaaggtgatcatggtcgaattcgctctacaaacaaacatagagatcgattcagcctctcgtttggctttcactgcagaccttatgatgttggcttacagggaagggggtaaagagcgaacaatcgcggaatttgaagcacttgcaaagagaactggatttgccaccatgaaagctatcccttgctctcttggtatggtggctcttgagcttcacaagaggtcctaa

SEQ ID NO: 692 - DNA, 1086 bp, Menispermum canadense
atggcttcaatccaaaaccagcccatcacctccaacaatgaggaggaagatttcctgttagccatgcaattgggaagttcttcagtgctgcctatggtactacaagctgcaattaagcttgaagtgttggagattatagctaaagcaggccctggagcaaagctttcacctaaagagatagcatctcaacttcccactcaaaacccagagtcccctgctatgcttgatcgaatgatgcgccttcttgcaagctactctgtgctcacttcaactgtaatgactcatgacaatgaccaagttgaaaggctgtatggtctggcacctgtttgcaaatactttgttcgcaatgaagatggggactcactttctccatggatgtttcttattcaagacaaggtcttcatggatagctggtacaacttgaaagatgcagtttttgaaggaggggtcccctttaacaaggttcatggggtacatgcatttcaataccctggcatagacccaagattcaatcaggtcttcaatggtgcaatgttcagtcacacctccattgtaatgaaaaaaattcttgaaatatacaaggggtttgagggtctgaaagaagtggtggatgtggctggtgggattggaaccacaatgagcataatcacttcaaattaccctacaattaagggcgttaactttgatttgccccatgttatagaacatgccccatgttttcctggtgtaacgcatgttggaggagatatgttctctagtgttcctaaaggagaagcaattttcatgaagtggatacttcatgattggagcgacgagtattgtttgaagttattgaagaattgttacgatgcgttaccaagtaacggaaagttgatagttgtagaagcaattcttccagtggctccagagactgatgctgctgctaaaagcctctgtcacatagaccttgtgatgatgacacagaaccctggaggaaaggagaggacatatgaagaatttgatgccatggcagtaggagctgggtttgccggaattaggaaagtatgttgtgtttataactactgggttatggaattctacaaatag

SEQ ID NO: 693 - DNA, 1074 bp, Menispermum canadense
atgcaggctttgacccaatcaccagctcatcatgaaggagacgaagaagaagaacaagtgttctccatggccttactgttggtgcattctccattgctgtcaatggcgatgcaagcggccattgagcttgacctgtttgagatcatagcgagagcaggccctggtgcgcttctctctgcatcagaggttgcagctcaagttcccactcacaacccaaaggcccctttcatggtggatcgcatacttggtttcttggcttctcactctgtgcttacatgctcttttaataatgataatactgaaaggctgtatgggttaacaccactttgtaaatacttggtgagggatgaggatggagggtccctggctcccttggccaggactgacagggccatcttagatgctgggttacacttgaaagaagcagtcctagaagatgtgcttccattcgaaaaggtccatggagtatctttttttgagtacatgggcaagaaggaccatcgactattcaaggcacccgacttcaattacactaaaatagtgacgaagaagattcttaaaatatacaatgggtttgagaacagaaaacaggtggttgatgtgggaggatcatatggaactgtgattagaatggtcacttccaagtatccctcaattaagggcattaattttgatctgcctcaagtgataggtcgtttgcctcccattcctggtgtgaaacttgttggtggagacatgtttgtaagtgttcccaatggagacaccataatcttaaaatcaatacttcatgactggaatgacgaacaatgcgtaacgatactgaagaattgctataaagcattgcctgaagatggaatggtgattgtcctcgagatgattcttccaactacactagagacgaatgcttctgcaaaggaggttcgcaacatggaccttatgcttatgttacttgggggacaagaaaggactgagaagcagtatgaagccttggccaaggcagctggatttgcccacatgaaattggtttgttgtgctttcaacttttgggtcatggaatttaacaagaagatgtga

SEQ ID NO: 694 - DNA, 1077 bp, Menispermum canadense
atggattcaaccaaaaaccagcttgaatcaacaatggaagaagagaaggatttgttattcgccttggaattggtaggagcttcaaccataacaatggtcatgtgggcagcagccgagctcgacttgtttgagattatagcaaaggccggacctggagcgcagctttcttcatcagagattgcagctcatattccaacgcaaaacccagaggcctcagacatgcttgatcgcattctaagcttccttgctagccacactgtgctcacatgctctgttgtgagccatgaagatggcctagttaagagagtgtatggtttggcacctgtgagcaagtactttgttaaggatgaaaatggcgggtctttcgtttccttgcttaccttggtgaagaccgtcaaggatgtctggtaccatctgaaagatgcaatacttgaaggtgggattccgtttcataaggttcatggcatgtccctgttccagtatcttggaaaagaaccagagcagaatcaacccttccattcacatagcttcaatctaactgatatgatcatgacaaaggttctcaagacgtataaggggtttgatgacttgaaagaagtggttgatttgggagggggacttggaaccaccattagaatgatcacttctatgtaccctaacatcaggggtattaattttgatttgcctcatgtgatagcacgcgcgccacctattcccagagttgaacatgttggtggagatatatttggcagtattccgaaggcagacgccattgtcatgaaaaacatacttcacatgtggaaggatgaacaatgctcagtgatattgaagagctgttatgaagcattacctgataatggaaaggtgatcgtcatcgagatcattcgtccgacaattcctaactcagacgctgcatcaaaatcagcctatcgattggatgtcacaatgatgcttcatgggggaatggagagaacagaagtagagtttgagaccttggcaaagagtgctggatttgctggtatcaaacttgcatgccatgcttattcctgggtcatagaattttgcaaaaacctgtga

SEQ ID NO: 695 - DNA, 1056 bp, Nandina domestica
atggcaatgaacggaaaggctaatgaatttgaagacatcaaagctcaagctcatctatggaaaatcatttacggtttcgcagactccctagtccttcggtgtgccgttgagcttggcattgcagacatcattagcaacaacaacaagcccatctcactctcctgcctagcatcaaagcttccacttccgcatgtcaacctcgatcatttgtaccggataatgcggtacttagttcacatgaaactactaaaactagtagtgaatgaaaacggtgaaaaactatacgcacttgaaccaatttcaacattgttgttgaaggatgcaaagaggaacatggttccaatggttcttggaatgactcagaaagattttgtgaccccatggcattacatgaaggatggtttgagcgacgatggtacggctttcgagaaaggtatggggatgaccatatgggagtatttacaaggacatcctgatcaaagccaattgttcaatgaaggaatggcaggggaaactaggctgctaacttcctcactcatatctggatgtggagacttatttaaaagtcttacatctcttgtggatgttggtggaggaaatggtactaccattaaagcaatttcagatgcttttcctcacattaagtgcacattatttgatctaccttatgtcattgccaactcttatgatcatcctgatatcgaacgcatttctggggatatgttcaaatctgttcctagtgctcaagccatcttactcaagctaattttgcatgactggagtgatgaagactgcattaggattttgaagcaatgcaaggaagcagtgccaaaagagggaggtaaagttataatagtggatgtggcattggatgaagaatctgatcatgagcttactagcactagattgatacttgatattgatatgttggtgaacactggtggtaaagagaggactaaggaggattgggataagcttgttaaagctgcaggttttcgaggtttcaacatcaggcacatcgcagccatccagtccgtgattgaggtatttccatag

SEQ ID NO: 696 - DNA, 1053 bp, Nandina domestica
atggaagtaatgaaggagcaagatgtatcagctcaagccaagatgtggaactacatttatggattttcagaaacactagttctaagatgcgcggttgagcttgacattgccaatatcattcacaatcatggaaagcctataactcttccagagttagcatcaaaacttccaaggcagcctgtcaattctgatagtttgtatcgagtgatgcgtcatttggcacacatgaagcttttcactaaaacaaaggtggacggagataccaaatatgagcttgcaccatctgctaagtttcttgttaaaggggctgataagtgtatggttggtgcactattggcaatcactgataaggatttcatggcaccatggcattacatcaaggatgggctaacaggtgatagcaagagcactgctttcgacaaggcattgggaatggatatatggacatatatgggaaagcatccagagaaaaaccagttgtttaatgaagcaatggcctgcgacacaaggcttgctatgtctgcgttggtaaatgaatgcaaagacaagtttaatgggataaaatccttggttgatgttggtggaggaactggaactgcagtgaggaacattgctaaggcatttccccacattaagtgtactgtttacgatcttcctcatgtcatcgctgactcccttgcttatcctgaaattaatcgcattgcaggtgacatgtttaagtccgtacctaaagcggatgccatactaatgaagtgcatacttcatgattgggctgacgaggagtgcattgaaattctaaagaaatgcaaagaagcagtgcctgaagatggggggaaagttataatcattgacattgtactgaatgtggaatcggatcatccttacacaaagatgagactaactttggatttagatatgatgctcaacactgggggaggcaaggagaggactgaagaggagtggaagaaactcatccaggctgcaggtttcagaagctacaacatcacccagatatctgccgtacaatctgtaattgaggcttttccttattaa

SEQ ID NO: 697 - DNA, 1104 bp, Nandina domestica
atggagagagggctcatcaatgaagatggaggagaggaggttcttcaggcacaagctcatgtttggaatcacatgttcaactacataagctccatgtcactcaagtgtgcaattcaattaaaaataccagacatcatacacaaccatcctcacaaacctattactctctctgaactgtccaaagaacttcaaatccccacgaagaaatcctcatatttgtatcgccttatgcgcgtattagtccattctggtttttttgcaatacaaaaaatacatggaactcaagaacaacttgaagatgaaggttacgtattaacactttcatcaaaacttcttacgaaaactcatccagggagagtgacacctttgttgcagctgatggtggatcctgccatggtaaaaccttggtacttcatgagtgattggttccagtcgagcgatgatgtgattaacccatttgacgccgcctatgggatgagctattgggagtactgtggtgagaaccaagaatttgggaaagtttttgatgaggccatggcttgtgattctcaagcagtgatgagtgttgtgttgaaggagtgtaagctgaagtttgaaggggtgaagtcattggttgatgtgggaggaggtacaggaactgtgggtagactcattgctcaagcctttccaagcataaagtgcattgtgtttgatctaccacaagtggttgcaaccatgcaagggggtcagaacgtggagtttgttagtggcgacatgtttgagtccatcccttccgcggatgtagttcttctaaagtgcatcactcatgattggagcgatgaggagtgcgtaaagatactaaagcgatgcagggatgcaattccatctaaagaagagggagggaaagtgattataatcgacatggtagttgatgattccaagaacagaggaaattatgagtcaactgaaacacaactcttctttgacatgttgatgatggttttggtgactggaagagaaagaactgagattgaatgggagaaactcttcttggatgctggttttagtagctacaacatcactcctattttgggtgtgaggtctttcattgaagtatttccgtag

SEQ ID NO: 698 - DNA, 996 bp, Nandina domestica
atgtcactcaagtgtgcagtccagttaggcataccagacataatatacaaccatcctcacaaacctatcactctttttgaacttgtcaaagcacttcaaatccccaagacaaaattcccttatgtgtatcgcctcatgcacattttagtccattctggatttttcgcaatacaagaagcacatgaaactcaagaagaaggttatatattaacaccttcatccaaactccttttgaagggtaatgccaaaagcatgtcagcatttgtggtaatggtattagatcctatgttggtaatgccttcctgtttcctcagtgactggttccagagaagtgatgagatcacaccatttgaggctacaggcggaacgagcttttggaagtatggtgctgagaatgaacagtttgggaaattgtttaatgagtctatggcttgtgatactcagttggtgatgagtattgtgttgaaagagtgtaagtcgaagtttgaagggctaaagtcattggttgatatagcgggtggtacaggaactgtgggacggatgattgccgaagcctttccaggggtcaagtgcactgtgtttgatgcacctcatgtggttggagcattgcaagggactaagaatctggattttgttagcggtgacatgtttgagtccatcccttctgctgatgtccttctcttaaagtggatcatgcacgattggagtgacgaagaatgcatgaagatactaaagaaatgcaagaaagcgattccatcaaaagaagagggagggaaattgatcataatagacatggtagttggtgactctaacaacagaggaaactatgagtcaactgaaacacagcttttgtttgacatgttgatgatggttgtgctacccggaaaagaaagaaccgaggttgaatggaagaagatcttcttagatgctggtttcagtagctacactatcacacctgttttggggttaaggtccctcattgaagtatttccttag

SEQ ID NO: 699 - DNA, 1065 bp, Nandina domestica
atggcccaagaacaagaagttgaaaggctagctgcaactttgcaaggccaagcagatatatggcaatacatgtttgcatttgtagactctatggccttaaaatgtgcggtggaactaggcatcgcggacataataaactcccatggcaccccaatcaccttaaccaaaatcatccaaggcatcgatgctccatccccagacatctcttacctctctcgaatcatgcggttactagtacggaaacgcatcttctctgctcaacccaatggagttgacactctatacggcctcactgagtcctccaaatggctccttaaaggcacagaattcagccttgcacccatgctactagcagagaaccatccaatgttattagctccctggcattacctgagtaaagtcgtggaagaaggtggcgtagcgtttgcaaaggcacatggaaaggagatatgggagttggcttcagaaaacgaagagcttaataaggttttcaatcaaggcatggcttgtacttctaaggtgaccgtgaaagccattttttcggtgtatagagatagatttgagggtgtgagaacacttgttgatgttggaggaggaacaggacgtatgatcggagaaattgtgaagcaacatccaaatgtaacgaagggtattaatttcgatctaccacatgtggtggcaacggcacctgaataccctggggttgaacatgttggaggggacatgtttgcggcaataccacaagctgatgcgatcatcatgaagtggataatgcatgattggagtgatgaagattgcatcaagatattgaagaattgtcatgaagccatacccaagaaaacagggaaagttataattgtagatgttgtgttgcacccagaaggtgaaagcctctttgatggtacgcgtttggcattcgatttgttaatgattgcgcatgcttctggtgggaaggaaaggactgaaaacgaatggaaaaacctattggagaacggaggattccctcgctacaagatttttcaacttccaactgtgccatccatcatcgaagcatatcctgaatag

SEQ ID NO: 700 - DNA, 1020 bp, Nandina domestica
atgaaagctcaagctttgttatggaaatacatctatggttttactgagtcactgagtctcaaatgtgcaattcaactcggtatcgctgatactctttacgaacacggccaacccatgagtctctccgagttagcttcgtcgctcacacaaccttccatcaaccaagagcgactattccgacttatgcgcttcttagtctacatgaaactcttcaaccgagacgactcacaaggggtgaccaagtactcactcacccccgagtcaagactcctggttaaatcccaagacaagaaccttgcatcatttggtctcttgcagtactatgagatggacgcttggcatcatttgagtgctgcagtggaaggtggggttacaccatgggagagatgccatggtgtggagtacagaaagtactttgcgaatgactcggtggcgaatcggttactcagtgatgctatgacgagtcacaccagtatggtgactgatgcattggtgagaggttgtgtggaaaatggtgtgctggatggggtgcgttcattgattgatgttggtgggagtactggggtggctgcacgcgcaatagcaatggcgttccctgaaattaagtgtgcagtgtttgatctgcctcatgtgattgccaatgcgcccgagtgtgccgaggtgaatcgcatcggaggggacatgttcgtatctataccaaaaactgatgtagttttcatgaagtcagtgttgcatgactggggtgatgaagattgtgtaaagatattgaagaaaagcaaagaagccatatctgaaagcaaacaaggtaaggttgtgatagtggacatagtgatggatatggaatcaagtgatgagttcacaggtgcaagattgggcatggaaatggacatgttggtcactgttgggggcaaagagaggagcaaacaagaatgggagaagctcttcaaatctgctggatacagccggtacaaaatcacacctatcgtcgccattgaatcaatcatccaagtttttccataa

SEQ ID NO: 701 - DNA, 1062 bp, Nandina domestica
atgagtaccatcgagaaatatttccttctgaatcaggttgatgaagaaaatgaagagattagagctcaagctcaagtgtggaaacacatgtatggattcgctgacaccatcatgttgcggtgtgcacttcgacttgagcttcccgacttaatccataagtatggtcctatgacgttatcggagttagcaagtaagttacctttgaaatccatcaatctcgatcgattcaatcacatcatgaggtatttagtacacatgaacctcttttcgattgatatggaaaaggcttatgatcaaagaaaatatactttaactcgagcatctgaacttctcgtgaaatcccatgagaagagcttggccccatttgcaatgttgcaaactcacccccaagagttttctctttggggacattttattgaaaatctcgatgaggccaagcagtacatggaagtgtaccatgatatggaccatgatgaggagtgcaatagattggttaatgaggccatgactagccataccaagagtatggtctcagccttggtgatggggttgaagaaggagaggattcttgatgatattaaatcacttgtcgatgttggaggaagcgaaggaattgctttgaaggcgattatggatgttggttcgcatgttaagtgcattattatggacttggctcatgttatagacagtgtacctaaggacccaagactggatttcttggctggtgacatgttcggttttgtaccccaagctgatgcaattctgttgaagtctattctccacaactatgatgatgatcattgcctcaagatcttaagcaagtgcaaggaagcaatacctgaaacaaaggggaaggtaataatagtggaaactatagttgacacagagaatttgccagagttctcttcagcaagattgggtttggatatggaaatgttatgcatgggaggaaaagagaggactaagaaagaatgggaatgccttttacacaaagctggatattctcatcacaagataattcccatcatggctattgaatccattattgtggcctacccttaa

SEQ ID NO: 702 - DNA, 1068 bp, Nandina domestica
atggaagccaaatccagagtatgggaactcatgtacggctttgccaactctatgaccctcagatgtgcccttcaacttggtcttccggatcttgttcacaaaaatggtggaccaatgaccctaactcaaatagtcaattcacttcccattcggggctctcccgacccacatcgtgtgtatcgcatcatgcgtttcttagtgcaaaataatctatttacatgcaccaaagatgatgggtcgggcgagctaaaatatgggttgactgccgaatccgaattgttggtgaaagacaatgagaagagtttggcaatgtatgctttgcttgtgttatgcccggcccaaataaccgcttggcaacatttgatcgacggtttagatagttccacgtatacttggatggaacttcacaagatgacgtggcaagaatcggcagtgaaagatcctcaattgctcaagctgtacaaccaatcaatgacgggatacagtagtcacgtggtggaggcattggtgagtggttgtgcacgtgagaatgtgttcgataactcggtacactcgattcttgatttaggtgggaacactgggattgtagctaaggcgattgttgatgcatttcccgatatcaaatgtacggtgatggacttaccagaagtgatcgctggaccccatgtcgaccatccttgtatagtttacatggctggtgatgtattttcttttgttccaaaggccgatgtcatctttatgaagtcttttctacatggttatagtgacaaggaatgccttaaagttcttaagaaatgcaaagaagcaattccaccagaaatagggaaagtcgtgttggtcgagatagccattgatgtaaacggattttccaagtattcaacggcgaaattgtgtatggacatggaaatgatgattgttggagggaaagaaagaaaccaagaagattggaaagatatattggataaagctggacttttagtcagcattaagttcatatctattgatgccgtggaatcgatcatcgaagctccgcccttaagcctcaatctacgtttaccctttaaataa

SEQ ID NO: 703 - DNA, 1035 bp, Nandina domestica
atggatgccaaatctagagtatgggaactcatgtatggctttgccaactcaatgaccctcaaatgtgcccttcaacttggtcttccagatcttgttcaccaaaatggtggacccatgacgttgacccaaatcgtcaattcacttcccattcaaggctttcccgacccagatcgtgtgtatcgcatcatgcgtttcttagtgcaaaataatctatttacatgcaccaatgatgatgggtcgggtgagctaaaatatgggttgactgcagaatccgaattgttggtgaaagacagtgagaagagtttggcaatgtttgtactgcatgtgttagacccaacccaaataactgcttggcaacatttgattaacggtttagatagctccacgtatacttggatggaagtttacaagaagacgtggcatgaatcggcagtgaatgatcctcaatcgctcaagctgtacaaccaagcaatgacgggatacattagtcacgtggtggaggcgttggtgagtggttgtgcacgtgagggtgtatttgatgattcggtacactcgattcttgatttaggtgggaacactgggattgcagctaaggcgattgttgatgcatttcctgatatcaaatgtacggtgatggacttaccagaagtgatcgatggaccccacatcgaccatcctcgtatagcttacatggctggtgatgcattttcttttgttccaaaggccgacgtcatctttatgaagtcttttatgcatggttttagtgacgaggaatgcattaaggttcttaagaaatgcaaagaagcaattccaccagaaatagggaaagtcgtgttggtcgagatagccattgatgtaaatggattttccaagtattcgatggcgaaattgtgcatggacatggaaatgatgattgttggagggaaagaaagaaaccaacaagattggaaagwtatgttggakaaagctggttttagtcagyayaarttcatatccatcgatgcyttggaatcaatcatcgaagctcgcccttaa

SEQ ID NO: 704 - DNA, 1095 bp, Nandina domestica
atgggttcagccccagacctaatcaaaatcacagctgaagaagaagatgaagcttgtaatcatgccatgcaacttgcaagtgcttctgtccttccaatggttttaaaagcagcaattgaattagatgttttagaaatcattgctaaagctgggccaggtgcatatgttgcccccaatgaaatagcttcacaattgtctaccagtaacagtgatgcacctattatgctcgatcgcatgttgcgccttcttgctagttataaggtactcactagcaccctccgcaccttggagagtggcaaggttgagaggttgtatggtttggcacctgtgtgtaagttcttggtgaagaacgaggatggagtgtctattgctcctcttgtgctcatgaatcaagataaggtccttatggagagctggtaccacttgaaagatgcagttcttgatggtggcattccattcaacaaggcatatggaatgactgcatttgagtaccatggcacagatcccagattcaacaaggttttcaataagggaatggctgatcactcaaccataaccatgaagaaaatcctccaagtatacaaaggttttgatggattgaaatcggtggtcgatgttggtggtggaactggtgctatagttaacatgatcatttccaaatatcctgcaatcaaaggcattaactttgatttgcctcatgtggtcgaagatgcgccaccctatcccggtgttgagcatgttggaggagacatgtttgtaagcgttcctagaggagatgccattttcatgaagtggattcttcatgattggagcgacgaacacagcttgaaatttttgaaaaactgttataaagcattgccagaagatggaaaggtgattattgcagaatcaattcttccagtattccctgaaacaaacctcgcggcaaacactgtttttcaacttgataacatcatgttagctcacaaccctggaggaaaagaaaggactgagaaagagtatgcagccttggcaaagggtgctggatttgctgagtttaaagttgtatgtggcgcttatagcacttgggttatggagttctgtaaaaagatatga

SEQ ID NO: 705 - DNA, 1059 bp, Nandina domestica
atggccactgaacagggtgcgaattacctctccgccctaggcttatcacgcttaatttgcctccccatggctctccgagctgcaatcgagctcaacgtatttgaaatcattgcagaagccggccccaaagctcagctttcttcatcacaaataatcacaaaaattcccacaaaaaacccaaaagcatcaatcgccctagaacgaatcctccgattgttaggtgcaagttcaatccttaccgtctcgactaactctgaaaaccaaagggtatatggcctaacaagtgagtcaagttgcttggtgactaaaggtgaccaagtttcagttgtcccaatgttgctattcacagctgataaggctgttgttgagagcttttacatgttgaaagatgttgtgcttgaagaagggtgtataccctttgataggactcatggagttaattttttcgagtatgcggggaaggaacctagagtgaataaagtgtttaatcaagctatggctgctgggtctattattgctttcgaccaagtttttaaggtgtataagggatttgagggaatgaaggagttggtagatgttggtggtggaattggaacttcacttagtaatattgtcaccaagtacccacatattaagggtatcaattttgagttggatcatgttgttgctgatgcacctaattatccaggggtgaagcatgtcgcagggaatatgtttgaagaggtaccaaattcagaaaacattttgctcaagtgggtgctacatgattgggatgacgaacggggcttgataatactgaaaaactgttggaaagcactgcctgaaaatggaaaagtgattgtagttgagtttgttcttcctcaagttctgggagacaatgctgaatctttcaatgccctgactcctgatcttctcatgatggccttgaatcccggtggcaaggagcgaacaatagtcgagtttagcgatcttgctaaagcagcaggttttgctgaagtgaagccttttccaatatcgcaaggtctccatgtaattgaattccacaaaacaaaggcctaa

SEQ ID NO: 706 - DNA, 1116 bp, Nandina domestica
atgcacgtaccagaaaccaccccaaaccaacacaacacatcaaacaaaaaaccatatcaaatggaagctcaagatggtcctaattatctttcaagcttaggcttatcgcacttaatatgcctcccgatggctctccgagcagcaatcgagctcaatgtattcgaaatcatctcacaagccggcccaaacgctcaactttcttcgtcacaaatagtcacaaaaatccccacaaaaaacccaaaggcatccatcgccttagaacgaattctccgaatgttgggtgcaagttcatacctgtctgtttccacaaactcatcaaaccaaagggtatatggtttaaccaatgtgtccacttgctttgtggccaaaggtgaccaagtttcagtagtcccaatgattctattcacatatgataaggcagttgtggaaagcctttacatgttgaaagattgtgtgcttgaagaagggtgcataccctttgataggactcatggggtcaatttttttgagtatgttggaaaggagcctaaggtgaatgaagtgtttaatcgagctatggctgctgggtctagtgttacttttgatgaagtgcttaaggtatacaaagggtttgagggaatgaaagagttgttggatattgctggtggaaatggaacttcacttagtacgattgtgtctaagtaccctcttattaagggtatcaattttgatttaggtcatgttattgctgatgcacctaattttcctggtgtggagcatgtagcaggggatatgtttgaagggataccaaattcacaaaacattatgctcaagtgggtacttcatgattgggacgatgatcgcagtctgaagatactaagaaactgttgcaaggctttgcctgacaatggaaaggtgatcgttatcgagtgggttcttccttcggtcatggggaacaatgctgaattttgcaatgcattgactaccgacgtctttatgatggctttgaatcctggtggaaaggagcgaacgatagctgaatttagtgatcttgctagggcaacaggattcgcagaagttagtccttttcccatttcacaaggcctttgtgtcattgaattccacaacaaaaactag

SEQ ID NO: 707 - DNA, 1065 bp, Nandina domestica
atggccaacaatggagaggacgatttcttgttagcaatgcaaattgccaacacacttgcattaccaatggtaatgcaagccattcttgatcttgaggtattggagatcatagcaaatgcaggtcatggtgctcagctttctccatcagagattgcatctcacctttctacgaaaaatcccaaggcgggggacatgcttgatcgtatgatgcgtctccttgcttgttattcgatccttacgtgttctgttgttacccatgcgaatggggtggttgagagggtgtatggtttggcgccggtttgtaagtactatatcaaggatgaaaatggagtttcgtttgctccttttttagagttgatgcaccataacgacattatgcagggctggtaccacataaaagatgcagttcttgaaggtggtgttccatttgacaaggcacatggaatggatgcatttcaatactatggcacgaaaccgaagttaaatgatctcatcaatcgggttcagttgattcacacaacgaccatcgcaagtaaagttttggagatttacaaaggatttgaaggcctaaaagaggttgttgatgttggtggagggcttggaatcatgattaatagcatcgttaccaagtatccgacgattaagggcattaacttcgacttgccacaagtgatcgagcatgcaccatcctatccaggagttgaacatattggaggagatatgtttgcgacaattccaaaaggagaggctattttcatgaagtatattctacatgattggagcgacgaacactgtttaaaattgctgaagaattgttacgaagcgattcctgatcatggaaaagtgattgtggttgagacaatagcaccattaattcctaaaaatgatattacggcaatagttccatgtcaagaagatgttatcatgatggccgaaatgcctggagggaaggaaagaacagagaaagagtttgagaagctggcaatggaagctggatttgctgggatcaaatttgtgtgtcctacttgtagttattgggtaatggaattttgtaaaatgatgtga

SEQ ID NO: 708 - DNA, 999 bp, Nandina domestica
atggattcaacccaaaaccaaatcagaatcaaaatcacagctgaagaagaagatgaagcttgtaatcatgccatgctacttgcaagtgcttctatccttccaatggttttaaaagcagcaatagaacttgatgtgtttgagatcattgctgaagctgggcagggtgcgtatgtcgcccccagcgaaatagcttcacaactgtctacaagcaacaccactgctccgatcatgcttgatcgtatgttgcgccttcttgctagttacaaaatactttctagcaccctgtgcactgtcgacagtggcagggttgagagaatgtatggtttggctcctgtgtgcaagttcttggtgaagaatgaagatggagtgtctattgctcctttggtgctcatgaatcaagataagatccttatagagagctggtatcacttgaaagatgcagttattaaaggtggcattccattcaacaaggcatacggaatgagtgcatttgagtaccatggcacagatcctagattcaacatggttttcaataagggaatggctgatcactcaaccataaccttgaaaaagatgctccaactatacgatggatttgatgggttgacatccttagtcgatgtgggtggcggaattggtgctatagttaacaggatcgtgtcgaaataccctacgattaaaggcattaattttgatttacctcatgttcttgaggacgcaccgtcatatcccggtattgaacatattggaggagacatgttcgtagacattccccagggagatgccatctttatgaagtggattcttcatgattggagcgacgaatattgcttggaaattttgaaaaactgctacaaagcattaccactagatgggaaggtgatcattgtggaatcgattcttccagtgttccctgaaacgaacctcgctgcaaaaaatgtttttgcagctgacaacatcatgttggctcacaatcctggggggaaaagagaggactga

SEQ ID NO: 709 - DNA, 1050 bp, Nigella sativa
atggctttctatgcaaatgatgaagctctagacgtcgaagctcaagctcatgtatggaaaatcatctatggctttgctgattccctggtcctccgatgtgcagttgaactcgagatattcgacatcattggcaacaacaactccatccaactctccgagttggcctcgaagcttccagttgcaaatgtcgtcccggatcatttgtacaggctgcttcgttacttaatcaagatggaactactaagactggaaacctcaaacaagggtgtaaaagaatacacactccaacccactgcacggttgcttcttaggaatgaaaagaggagcatggttccaatgatacttggcaacacacagaaggatttcatgactccttggcactcaatgaaagatggtcttggccacagtggtactgcttttgagaagtccaagggaatgactatatgggagtatttggaaacacatccagatcaaagccaactttttaacaaaggtatggctgctcaaacgaggcttcttacttcttcactcatatctgtaaacaaagacatctttcaaagcatcaactcacttgttgatgttggtggaggtaatggtactactattaaagccatttctgatgcatttccacacattcagtgcactctctttgatcttcctcatgtcatagccaattcttatgaccaccccaatatccaacgaattggaggtgacatgttcaagtctgtgcctagcgctcaagccatcttactcaagttaattttgcatgactggagtgatgaggatagtattaagattttgaagcaatgcaaggcagccttgacggaaaatggaggcaaggtgattatagtggacgtagcactagatgaggactcagaccatgagctgagtagcacaaggttgattcttgatattgatatgttggtgaatactggtggcagagaaaggactaaagaagattgggagaggctggttaagtctgcagggtttagtggctgcaacatcaggcacatagcggctattcaatcagtgattgaggtctttccatag

SEQ ID NO: 710 - DNA, 1065 bp, Nigella sativa
atggaggagatgataaatggagatgaatcaaaagaaattcttaaagctcaagctcacatatggaagtatacattcaattacataacttccatgtccctaaagtgtgcagtccaattaggtatacctgatatcattgctaatcatggtaagcctctcaacctctctcagttggtgaatgaactctcaatccctcacctgaaatctccacatctataccggctcatgcgcatattggttcactctggcttctttgccattgaagaaggagaaggttatgtcttgacaccttcatctaagctgcttctttccaagaatcaaaacacaaacttgtcaccttttgtcctaatgatgatggatcctgtcttagttacaccatttcatttcctaactgattggtttcaagggaatcaaactacagcattcaaggtagctcatgggatggagatgtgggattattatggccaacactctgatgttaacaagtcctttgatgattcattggctggtgactcagggttggtgatgggtgttgtgcttaaacactggaaggagatgtttcaagggtttggttcattggtggatgtaggtggcagcacaggtagtgtagccaaggctatctctgaggtatttccactcatgaaatgcactgttcttgatcttcctcatgtcgtctctgacatgaaagggagtaaaaacttggaatttattagtggagacatgttcgagtacatcccccctgcagatataatcctacttaagtggataatgcatgattggagcgacgagaaatgcataaagatactaaagaattgcaaggaagcgatatcggaacacaaaggaggaaaagtggttgtaatagacattatactggatgaagaccaaggattaagaagaaatgattcagttgaaactcagctttgccttgacattttaatgatggtttcacatgctgcaaaagaaagaactgaggctgaatggaagaagctcttcttagatgccggtttctcaagcttcaaggttactcgtggtttgggtttaagatctatcattgaagtcttcccttag

SEQ ID NO: 711 - DNA, 1095 bp, Nigella sativa
atgactcatggaaatgaagcaaagagggagatgatgaatgaaaatagagcaaaagagattcttgaagctgaagctaatgtttggaagtataccttaaactacattacttctatgtcactcaaatgtgcccttgaattaggcatacctgatatcattgccagccatgacaaaccactcacactctcagagttagtgaaggcactgtccatccctcagacaaaatctgctcacatataccgcctcatgcgtttgttggttcactcaggcttctttgctgttgaaaacgttcttcaagatgaagaatgttacatactgacaccttcatccaagcttttcttgaagaacagcaacacaaacttgtctcctttctcactaattatgacggatcccctatttgttacttcttgcagtagcttgagtgcctggttccatagcaccagtgattacacaccatttgagtctgcacatggaaatgacttttggagttatttggagcaacaccctgattctaacaaagatttcaacgacgcaatggcgagtgatgccaaatttgtgagcatgatggtggagaaagagctgaaatcaatgttggaggggttggagtcattggttgatgtagggggcggcacaggaactatggtcaagtccatctgcaaagcattcccaaatttaaaatgcacagttctagatcttgctcatgtggtctccaacatgcaaggaagtcacaacttgaaatttgttagtggagacatgtttcactctgttccgtctggcgatgtaatcctacttaagcatattctgcatgattggagtgatgaggagtgtgtgaagatattaaagcgatgcagggatgcaatctcaaacaaagataagggagggaaagtgattataattgaagttgtgctggaccacaagagaggagcccatgatctgattgaggcacaactctgttgtgacatgcttatgatgcttgcggtttctggaaaagagagaaatgagaaagaatgggaaaaactcttcctggatgctggttttacaggttacaagataacacatgccttgggtcttagatcaattattgaagttttcccttaa

SEQ ID NO: 712 - DNA, 1041 bp, Nigella sativa
atggaagtagaaaaccagaacctctcagcacaagccaaactctggaactacatctatggctacgcggaaacactggttctcaaatgtgcagttcaactcgacatagccaacataatccataaccatggcacccccatttctctttcagacttagcttctcttcttccaaatcaacctgtaaaccaagacgctttgtatcgcgtcatgcgttacttagtccacatggaactcttcaccaaatcaacctccaatggcgaaacaaactactctcttgggccatctggtaagtttcttgttaaaggttgggagaaatgtatggttgattctattttagtgatcactgatgaccactacatgtctccatggcattatcttgggcatggagtatccagcaaaacaagcactgcttttgagaaggtgcgagggacaaatatatgggagtatttggctgatcatcctgacaaaagtcagttgtttaatgctggaatggcgaatgatactagacttgtaatgtcagctgtggtgaaggaatgcaaaggcatttttggtggtgtaagtacacttgttgatgttggtggtggtactgggactgctgttaagtatgttgctaaagcgtttcctgatattaagtgtaccgtctatgatcttcctcatgttgtcgctgattcatcaagtgattctggaatcaattttgtggaaggagatatgttcacaagtgttcctaatgctgatgccattatgatgaagtgcatactacatgattgggatgatgataaatgtgttgaaattttgaaaagatgtaaagaagcagtaccaagagatggtggaaaagttattatcatagatatcgtattggatgttgatttcaaacatccttatgcaaagatgaggttgactttggatttggatatgatgacaattggaggaaaagagaggagtgaagaggaatggaagaagctcatcgatggtgcgggctataaaggttgtcagataacccagatatcagctgtccaatcagtgattgaagctttcccttattaa

SEQ ID NO: 713 - DNA, 1035 bp, Nigella sativa
gttgataagcagaatctcgcatcagaagctagactctggaactacatctataactacgctgaatctctagtcctcaaatgtgcagtgcaactggatatagccaacataatccacaaccatggcactcccatttctctctcagacttagcttctcttcttccaaatcaacctgtcaaccaagacagcttgtatcgcgtcatgcgttacttagttcatatgaaagtattcaccaaatcatcctcaaatggggaaacatactactccattgggacatgtggtaggttccttgttaaaggatgggagaaatgtatggttgattttattttaatcaccactgatgaggacttcatgaatgcatggcattatcttggtcatgcattatccagcaaaacaaatactgctttcgaaaaggcgcaagggacagacatatgggggtatctggctgatcgtcctgagaaaaatcagttgtttaatgctgcaatggcgaatgaaactcgacttgtaatgccagctgtggtgaaggaatgcagaagcatttttgatggtgtaactacacttgttgatgttggtggcggtactgggactgctgttaagtatgttgctaaagcgtttccagatattaagtgcactgcctatgatcttcctcatgttatcgctgattcatccagtgattctggaatcaattttgtggaaggagatatgttcacttgtgttcctaatgctgatgccattatgttgaagggcgtactacatgattgggatgatgataaatgtgttgaaatccttaggaaatgcaaagaagcagtgccaagagaaggtggaaaagttattattatcgatgttgtattggatgttgactctaaacatccttatgcaaagatcatgttggcgttagatttggaaatgatgatgatgggaggaaaagagaggagcgaagaggaatggaaaaaactcatctatgatgcaggctataaaagttacgagataacccagatatctgcaaagccatctttgattacagcctacccttattag

SEQ ID NO: 714 - DNA, 1062 bp, Nigella sativa
atggcagagcaggaagccatgacagaaggccaagcacagatctggaagatcattcttgcttatgcagattcaatggcaataagatgtgttgtggagcttggtgtaccagatataataaacacacacggtagtccagtttccttacaggagatagtagcttgtattaagtcttcatctccagatgtcgaatacttaaaccgaatcatgaggttgtgtgtccgcaagggcttattcagcacagcagctgcacccaacgaagatggcgacactctatatggccttactcctgcttccaagtggctgctgagtgataacgagttaagcctagccccaatggtacttgttgcgacccatgaacgcctgatgaccccatggcgttactttagccagtgtgttaaagaaggtggggattccttcactaaggcctatggttccgcattctacgagtatggttctgtccaaccggagttcaataatctatttaattctgcaatggctggtacatctaagatctcgggtgaagcactgttggcgagttacaaggatgggtttgaggatgtgagaactctagtggatgttggaggtggtacaggaacattgatcagggagatcgtgaaggctcaccctcatataaagggcatcaattttgatctaccacatgttgtggcgacagcacctgaggccacaggagtgcagaatgtttctggggacatgctcgtagaggttccttctgctgatgcctatctcctcaagacaatatttcatagttggaatgaagagagttgcataaggatattgaaaaattgtcgcaaggcaatggagaaaagtggaggaaaattaataattatggatattatgttaaggcatcaaggaagtgatttatttgatgagacgcgagtggcttttgaccttgtgatgatggctactagttcaggaggtaaggaacgaactgaagtagaatggaagagcttattgaaagttggaggattttctcgctacaaagtcattgaatgccatgctcttcattcaattatcgaagcatatccatccgaactagtttaa

SEQ ID NO: 715 - DNA, 1062 bp, Nigella sativa
atggcagaggaggaagcagccatggtagaaggccaagcacaaatatggaagatcattcttgcttatgcagattcaatggccataagatgtgctgtggagctcggaataccagatataataaacaaccacggtggttcagcttccctatcggagatagcagcaggtatcaactctccatcaccagatgtggaatacttaaaccggatcatgaggttatgtgtccgcaagggcttatttaccacagcaaccacaaatggaggtggtgaaactctatacggtcttacttctgcttccaagtggctgctgcgtgattatgagctaagcctggcaccaatggtacatgttgccacccatgaatgggtggtatctccatggcgttattttagccagtgtgtaaatgaaggtggtgatgcctttactatggcttttggttctaatatgtttgagtatgcttctgtgcaacctgagttcaataaacttttcaattctgcaatggcttgtacatccaagattgccatggaagcaatgttggagagctacaagagtgggtttgaggatgtgagctccattgttgatattggaggtggaacaggaacattgatcagggagattgtgaaggcgcatcctcatgtaaagggcatcaattttgatctaccacatgttgtggcgacagcacttgaggccacaggagtccagaatgtttctggagacatgtttgtggatgttcctcctgctgatgcctacctcctcaagtcaatattgcatgattggaatgacgagaattgcataaagatattgaaaaattgtcgtgatgcaatgggcgaaaaaggaggaaaagtaataatcgtggaccttgtgttaaagccccagggaagtggtttatttgatgagttgcgcgtggtttttgaccttgtaatgatggctcttacttcaggaggtaaggaacgaactgaagtagaatggaagaacatacttgaaaaggctggattttctcattacaaggtaattgaatgtaatgctcttccttccattattgaagcatatccgacgatattaaactaa

SEQ ID NO: 716 - DNA, 1065 bp, Nigella sativa
atggcagaggaggacagagcgatgatagaaggccaagcacaaatctggaagatcattcttgcttatgccgattcaatggccataagatgtattgttgagcttggtataccagatataataagcactcatggtggtccagcttccctacctgagattgcagccgctattatctctccatctccagatatagaatacttaaaccgagtcatgaggttgtgtgtccgcaagggtttattcaccacaacggcagcaccaaatgaagctggtgaaactctatatggcttaactcatgcttcaaaatggctgctgcgtgataatgagcttagcctggcaccaatggtacatgttgccacgcatgaatgggtgatgtctccatggcgtttctttagtcagtgtgttaaagaaggtggtgatgctttcactatggcgtatggttctagtatgtttgagtatgcttctatacaacctgagttcaataaacttttcaattctgcaatggcttgtacatctaagctcgctgtcaaagcattgttggagagttacaaggatgggttacaggatgtgagatcgctcgtggatatcggtggtggaactggaaccttgatcagggagattgtgaaggctcaccctcatgtgcagggcatcaattttgatctaccgcatgttgtggcaacagcacctgaggctacaggagtcaagaacgtaagtggagacatgtttgttgatgttcctcctgctgatgtctatctcctcaagtcaatattacatgattggaatgacgagaattgcataaagatattaaaaaattgccgcaaagcactatcagaaagaggaggaaaaataataattgtggattttctgttaaagcctctgggaagtgatttatttgacgagacacgggtggttcatgaccttgtaatgatggctcttacttcagggggtaaggaaagaactgaagtagaatggaagaacttattggaagttggtggatttcctaggtacaaagtcattgaatgtcatgctcttccttgcattatcgaagcatttccaaatgtattaatttaa

SEQ ID NO: 717 - DNA, 1068 bp, Nigella sativa
atggaagaggaggaagcagccatgatagaaggccaagcacagatatggaagatgattcttgcttatgcagatacaatggcaataaaatgtgttgtggagcttggtataccagatataataaacacatatggtggtccagcttccctacttgagatagcagctagtatcaactcttcatctccagacgtggactacttaaaccgagtgatgaggttgtgtgtcagaaagggcttattcaccgcagcagcagcccccacaaacgaaggtggtgatggtcatgacactctatatggtcttactcatgcttccaagtggctgctaactgataatgagctaagcctagcaccattggtacaccttgggacacatgactcaaccatatcttcttggcgttacttgagccagtgtgttaaagaaggtggttatgccttttcaaaggcgtatggttctgaagtttttgggtttgcttctctgcaacccgaattcaataaactctacaattctgcaatggcatgttcatctaagatcacctccaaagcattattggaaagttacgagaatggatttcaggatgtgagatcgcttgtggatgttggtggtggaactggaacattaatcagggagattgtgaaggcacaccctcatgtacagggtatcaattttgatctaccacatgtcgtagccacaacacctgaggccactggtgtccagaatgtttctggagacatgtttgtagatgttccgcctgctgatgcctacatcctcaagtcggtgttacatgattggactgatgagaagtgcacaaagatattggaaaattgccacaaagcaatgggaaataggaaaggaaaaataataattgtggaacatatattaaagccacaaaaaagtggtatatttgatgagatcggtgtggttcaagatcttgtaatgatgatcggaactccaggaggtaaggaacgaactgaagtagaatggaagaacttattagaaactggaggatttcctcgctacgaagttattgaatctcatgatcttcactgcatcatcgtggcatttccaacataa

SEQ ID NO: 718 - DNA, 1080 bp, Nigella sativa
atggtgaacactctcgatcaaggagattcaaagcatatccaaaatgaagatattgaagctcaagctctgttatggaaacacatgtatggctttgctgatactgtcatgttaaggtacacagttacccttggcatacctgatatagttcacaaccatggcaccatttcattatctcaactcgcagctcagctaccaatcaatgacattaccattgataggctcaatcacttcatgaggtatttagttcatatgaaactcttcaaaatctccactgatgagatcagcaaagaagacaagtatgaactaacaccagcatccaagctcctagtcaaagatcatcacaagagcttggccgcgtacgtgatgttgcaaacccaccctgaagagttttcaatatggggtcgtgtgattgattatttagaaggtaaaaaaggttattgggaatcaacctatggggttcgaattgatgaaaagatagggaaagatcaagagatctataatcaccagcttgtcaatgatgctatgacaagcaatagtagattcatgataagtgcccttgtgggtggtttagtacaagaaaaggttcttgatggtgttcgatccattgttgatgttgggggaaactctgggatcactgctaaggcaatatctgatgctttcccagatatcaagtgtagtgttatggatttaaaccatgttatagagagtgttgttaaggatcccaagttaacgtatgtggcaggtgacatgttcagttctatcccgaatgcagatgctgttttactgaagtctatacttcacaactatgacgatgatgaatgtctcaagattttaaagaaagccacggaagcaataccttcaaaaggaagcaaggtgatcttggtggaaattgtaactgatctcgaaaatcagccagaactattttctgcaagattgagtatgaagatggaaatgatgctgctgggtggaaaagaaagaacaaagcaagaatggggaaccctgttaggcaaagctggttatagtcagcataagatcatacccataatggctattgaatcaattattgtggcctattgttaa

SEQ ID NO: 719 - DNA, 1092 bp, Nigella sativa
atggcttcaactcaaaacctgttaaacctcacacctgaacaagaagaggaagcatgtgcatatgctatgcagttagctagtgcatcagttcttcccatggtactgaaagcagccattgagttagatgtgttggagattattgctaaagctggtcatggtgtttattccactcctactcaaattgcatctcaactatcatccaccgccaaccctcactcccatgtcatgctagacaggatgttgaggttactggctagttacaaggttgtgagttgtaatctgagaactttggaagatggttcagttgaaagatcatatggacttgcacctactagtaaattcttggtcaagaatgaagatggtgtttctatggctcctttggtactcatgaatcaagataaggttcttatggaaagctggtaccacttgaaggatgcagtacttgacggaggaattccatttaacaaggcatatggaatgacagcatttgagtaccatggcacagatccaagattcaacaaggttttcaacaggggaatggctgatcattctaccataaccatgaagaagattcttgacatatacaaaggttttgagggcttgaaatctttggttgacgtcggaggtggaactggtgccatagttaacacaatcgtaactaggcaccccaccattaaaggcattaacttcgacttgcctcatgtgattgaagatgcacctgcttatccaggggtgcaacatattggaggagacatgtttgttagtgttccaaaaggagatgcaatattcatgaaatggattcttcatgattggagtgatgaacattgtttgaagtttttgaagaactgttatgaagcattgcctcaaaatggaaaggtgatcattgttgaatcaattcttccagtatttcctgagacaaaccttcccgcccatggcgtatttcagctcgataacatcatgttggcacataaccccggcggaaaagaacgaacagagaaagattttcaagcactgtcatctggagctggatttgctgatttcaaagtgatatgctgtgcttttaacagttgggtcatggagttctgcaaatag

SEQ ID NO: 720 - DNA, 1077 bp, Nigella sativa
atgggttcaatggaagaagccattaatgaagaagaaaactatctgtttgccatgcatctggtgggtgcttcagtactacccatggtgatgaaagtttcaattgagatggacttgtttgagataatagctaaagctggcccaggcgctttactgtctccaaacacaattgcatctcagttatcaataaaaaatccaaatgctgtgtctatgctcgatagagctcttcgccttcttgctagcttctctgtgctcacttcctcagttgtcagggacgaaaatggtgttgttgaaaggttgtatggtttagcacctgtttgcaaatattttgttggtaatgaagatggtgtttcattgtctccaatgttgcaattggttcagagtaaagtcttcatggatagctggtatcacatgaaagatgcaattcttgaaggaggaattccattcaaccgagctcatggaatgcattcctttgaatacccaggaattgatcctgaattcaacaagatcttcaatggtgccatgttcagtcactcgagcttgttcataaaaagggtgctcgaagtatatacaggatttgatggcctcaaggaagtgatcgacgttggtggaggagttggtaccacaatcaacttgattacctctaaacacccaactattaagggcataaattttgatctccctcacgtcattcaacacgcaccatcttaccctggtgttgaacatgttggaggggatatgtttgattgcgtcccaagtggcgaagcaatattcatgaagtggatactgcatgactggagtgatgaagactgcgtgaagttactgaagaattgttacaaagcattgccagaccatgggaaagtgatattggtagagggaattctacctgttgcagtggaaaccaaccctggggtacagagcctatgtgaaggagatcttattatgatgtcacagaatactggaggaaaagagaggttggaagaagagtttgagaatttagccaagggagctgggtttgctaggatgacaaaggcatgttctttctataatcactgggtgattgagttatataagaagtga

SEQ ID NO: 721 - DNA, 1095 bp, Nigella sativa
atgccatcttctcaaattcatgaaagaggcagtagtagtaatgaagaagaagattattcttttgcacttcaaatagctaccagtgctatgatgccaatgcttatgcatgctgcagttcagctggacgtgtttggtatcattgcgaaggcaggcccaggcgccaaactctcagcaaaatatattgccgatcagctgcccacacaagccccaagcacacctttcacccttgatagactgttgcgctttcttgctagtttctctgtgctcacttcttctctcctcacctccgaagatggcctaagtcagagagtttacggacttacatctgcatctaaattttttgtgccaaatgaggatggagtatcgcttgctcccttgatgatgttagttcacgacaaagcttacactgacatggggatgcaactaaaagaagccattattgacggcggaattccatttacaaaggcgcatggaatgcacgtgtttgagtacactaagatcaactcaaagttcaatcaagtcttcaacaatgccatgttcaaccacaccacaataatcgtgaacaagatacttgagacctacaaaggatttcaagaagttgaaaaggtggttgatgttggtggaggagttggaactgctattggtttaatcactgcaaaatatcccacaatcaagggtatcaattttgatttgccccacgttatccaacatgcacatgtttgccctggagttgaacatgttggaggagacatgtttgaaatggttcctacagggggatccattttcctgaaatggattctccatgattgggacgacgaaagatgtgtggtaattttaaaaaattgtaagaaggctttatcggaagatggaaaagtgattgttgttgaactagttgtgcctattgaagtggagagtcctgacagcaccacaagaaacgcgtatcaatgggaccttgctatgtggactatcagttcaggaagcaaagaacgaagctatgaagagtttaaacttctggcaaatgaagcggggtttactcgtatagagaaagtgtgttctgtttataacttttgggtgatggaattttataaaaaataa

SEQ ID NO: 722 - DNA, 1083 bp, Nigella sativa
atgggttctatagctgaaactcaaatgaagaaagaagatgatggtgtttacttatttgccatgcaactagcagtttcttcagtattaccaatggtaatgcagcaaacaatagagctcaaagtatttgaaatcataaacaaagcaggtgaaggtgcacatctttctccaactcagatagcatctgaactcaaaacccaaaacccagaagcacctgttatgttagatcgtatgttgagacttcttgctaaccattctgtccttagttgttcatttgtcactaaagatgatgggcatgttgaaagactttatggtttgacacctgtttgtaagtattatattccagatgcagatggtgtttctcttgctccattgatgatatggactaatgataatgataatgttcgatgttggcctagattgaaagatgctgttcttgatggtgggattgcttttgaaaaggttcatggtttggggttgtttgagtatcttgggaagaatcaaaaacataatgatctttttaatagagctatgtatatacatactagtgttattatgaagcagattgttgaggtttataaagggtttgatagtcttaatgttatggttgatgttggtggtgggattggtaccatgagtaagattattgcctctaagtatcctgctatcaagtgtattaattatgatttgcctcatgttattgaaagtggtctttctcatccaggtattgaacatgttggtggtgatatgtttgcaagcattcccaaagcagatgctgtcttcatgaagtgtatcatacatgattgggacgatgagcgttgcttggcgatattgaagaattgctacaatgcgcttcctgaaaatggaaaggtgattgtcgtcgacattgttctgtcaacgggagctgagactgaaaatggagctaaaggcacagcagagatagatgtttttatgatgatgcagtgtccaggcggcaaagaaaggactgttaaagattttgaagacttagcgaagggagctggctttggtaccataaatgttgtgtgttctctcagtaattattggctcatggagttccacaagtga

SEQ ID NO: 723 - DNA, 1068 bp, Papaver bracteatum
atgggtagcttagcaaaaccagctgaaacacaagaagtttccatcaaagatcaagctcaactatggaatattatctatggttttgctgattctcttgttctgcgttgcgctgtagagattggaatcgcggatattatcaaaaacaatgatggggcaatcacacttgcacaacttgcttcgaaactcccggttccaaatgtcagttctgattacttgtacagaatggtgagatacttggtacacctgaacatcttagcacaagaaacttgtaatggcggagttgagaaggtttactcgcttaaaccggttggtacgctacttttaagagatgcagaaagaagtatggtgccgatgatattaggcatgactgaaaaagatttcatggtttcatggcatttcattaattcaggtttaggagctggaggtggggtggtttttgcgggaggaatgggaatggatatatggaagtatttagaaagtaatcctgatcagagccagttgtttaatgaaggaatggctggagaaacaagacttttaactaaaactctgatcgaagattgcagagatacttttcaaggtttggattcactggttgatattggtggaggaaatggtacaacaatcaaggcaatccatgaagcttttcctcatatcaaatgttcactttatgatcttcctcatgttgttgccaactctcatgatctccctaacatcgaaaaagttcccggtgatatgttcaagtctgttcccagtgctcaggctatcttactcaagttgatcttgcacgactggactgatgaggagtgtgtcaacatcctaaagaagtgcaaagaagcaataccgaaagagacaggaaaagtgattatagtggatgtagcacttgaagaagaatccaaccatgaacttacaaagacaagattgattcttgatattgacatgttggtgaatactggtggtagagagaggactgcagatgattgggaaaatttgctcaaacgcgcaggctttcgctctcataggatcagacccattcgcgctattcagtctgtcattgaagccttcccttag

SEQ ID NO: 724 - DNA, 1074 bp, Papaver bracteatum
atggatactttatatgccaacccagctgaaacacaagaagaaatcggcatcaaagatcaagctcaaatatggaatttaatctatggttttgctgattctcttgttcttcgttgcacagtagagattggcttaccagatattatcaaaaacaataatgggccaatcacacttgcacaactttcatcaaaactcccgattccagacgtcaattctgaccacttgcacagaattcttagatatttagtacacctgaatatcttacgacaagaaacttgtaatggtggagctgataaggtttactcacttaaaccagctggtactttacttctaagtgatgcagaaggaagtatgataccaatattattagggatgactgaaaaagatttcatgcttccatggcattttatgaaagaaggtttaggaaatggaagcacaacagcatttgagaaaggagtgggaatggatgtatgggagtatttagaagctaacccagatcaaagtcggttgtttgatgaaggaatggctgcaacaacaagacttttaagtaaaactctagttgaagattgtagaggtacttttgaaggtttggattctcttgttgacgttggtggaggaaatggtacaacaatcatggcaatctctgaagcatttcctcacatcaaatgtacactttttgatcttccacgtgttattgctagctcacataatcaccctaacatcgaaagagttccaggtgatatgttcaagtctgttcccattgctcaagctatcttgctcaagatggtattgcatgactgggatgatgaagcgtgtgttaaaattctaaagaagtgcaaagaagcaataccgaaggagacggggaaagtgatcatagttgatgcagcacttgaagaagaatctgaacacgaacttacaaagacaagattgattcttgatattgatatgttggtgaattctggtggtagagagagaactgcagatgattgggagattttgctcaaacgtgcaggctttaggtctcataggatcagacccattcgcgctattcagtctgtgattgaagccttcccatag

SEQ ID NO: 725 - DNA, 1062 bp, Papaver bracteatum
atgggttcacaagcaactgaaacacaagttgttagcctcgaagatcaagctcaaatatggaatataatctatgggttcgctgattctcttgttcttcgttgcgcagtacagattggcattccagatattatcaaaaacaataaagggtcaatcacacttgcacaactttcatcaaaactcccaattccagatgtcaattctggtcacttacaaagaattataagatatttagtacagttggatatcttacaacaagaaacttgtaatggtggagctgaaatggtttactcacttaaaccagctggtactttacttttaagagatgcaaaaataagtatggtaccaatgctattaggtttgacccaaaaagacttcatggtaccgtggcatttcattaaagaagttttaggaaatggaagtgcaacagcattcgagataggcatgggtaagacaatgtggcagtatttagctgataatcctgaacaaagtcagttgtttgatgaaggaatggcgggagatataacacttttaagtaaaactctaactgaagattgcagtgatatttttcaaggtttagattctcttgttgatgttggtggaggaaatggtgcagcaattatggcaatctatgaagcttttcctcatataaaatgtacactttttgatcttcctcatgttattgctagctctcataatcaccctaagatcgaaaaaatacccggtgatatgtttaagtctgttcccagtgctcaagccctcttactcaagtcgatcctgcatgactggactgatgaagagtgtgtcaaaattctaaagaactgtaaagaagcaataccaaaagagacagggaaagtgattatagttgatatagcacttgaagaagaatctactcatccacttgccaaaaaaagattggttcttgatattgatatgttggtgaataccggtggcagagagagaactgcagacgattgggaaaatttgctcaaaagtgcaggctttcggtctcataagatctcacccattcgcgctatgcagtctgtcattgaagccttcccatag

SEQ ID NO: 726 - DNA, 1041 bp, Papaver bracteatum
atggaaacagtaagcaagattgatcaacaaaaccaagcaaaaatctggaaacaaatttacggttttgcagaatcactagttctgaaatgtgcagttcaactagagattgctgaaacacttcacaacaatgtcaaacccatgtctttatccgaattagcatccaaacttccggttgctcaacccgttaacgaagaccgtttgttccgaattatgcgttacttggttcacatggaactcttcaagatagacgctaccacgcagaaatactcattagctccaccagctaagtatttgttgagagggtgggagaaatcaatggttgattcaattttatgcataaatgataaggatttcttagctccgtggcatcatttaggtgacggtttaaccggtaactgtgacgcttttgagaaagcgttggggaagagtatttgggtttatatgagtgaaaatcctgaaaagaatcaattgtttaatgcagcaatggcttgtgatactagattggttacttctgcattggctaatgagtgcaaaagtattttcagtgacggaatcagaacactggtggatgtcggcggcggtaccggtactgctgtgaaaaccatatctaaagcttttccggatattaagtgcactatctatgatcttcctcatgtcatagctgattctcctgaaattcccaatattactaaaatttctggagatatgttcaagtctattcctagtgctgatgccatcttcatgaagtgcatacttcacgactggaatgatgaggaatgcattcaaatcttgaagcgatgcaaagaagcattaccaaaagatggcaaagttattatcgtggatgtcgtgatagacatggattcgactcatccatatgcaaaaattagactcacattggatttggatatgatgctcaacactggtggaaaagagagaaccaaagaagaatggaagatactttttgatgccgctggttttgcaagccacaaagtcactcagatatctgctgtccaatctgtaattgaggcttacccttattaa

SEQ ID NO: 727 - DNA, 1050 bp, Papaver bracteatum
atggaagtagtatacaaaattgatcaagaaaatcaagcgaaaatctggaaaatgatttatggtttttcggaatcattagttctcaaatgtgcagttcaactagagatcgcagaaactattcataaccatggaaaaccaatgtctttgtctgaattagcttctaaacttcccgttcaacctgtcaattcagatcgtttattccgtattatgcgttacttggttcacatgaaattattcaagatagaagtttcttcacttaatggtggaagtgcctactcgttagctccaccaggaaaatatttgataagaggctggggaaaatcgatggttgcttcgattttagcaatgaatgataacgatttgttagctccatggcatcatttaaatgaaggtttgactggtaattgtaacgctttcgagaaagcgttgggaaagagcatttgggtttatatgagtgaaaatcctgaaaagaaccaactttttaatgaagcaatggcgtgcgatactgaattagttaattcagctttggttaatgaatgcaaaagtgtattctgtaatggaactaaaaccttagttgacgttggcggtggtattggtgctgctatgatggcaatttcggaagctttcccgagtattaagtgcacaatctttgatcttccgcatgttatcgctgaatctcctgaaatgccaaatattacgaaaatttcaggtgatatgttcgagtctattccaagtgctgatgccatctttatgaagaacatccttcatgattggaacgatgataagtgcattcaaattttaaagcgatgcaaagaagcactaccacgaggagggaaagttattatcgttgatatagtactggatgttgctgattcggttaatccattttcaaaaattagacttgcgtccgatttggatatgatgcttaacactggagggagagagagaactgaaaaagaattgaagaaacttattgatgcctcaggttttgctagctacaagattactcaaatgtctgcagttcaatctgtgatcgaggtttatccttaa

SEQ ID NO: 728 - DNA, 1092 bp, Papaver bracteatum
ctgaattcgactagcaaagaggagattgagctgatacaagctcacactcatatctggaagtatgtattcagctatgcaaattccatgtctctcaaatgtgttgttgaattaggcatacccgacataatccacagccatggaaaacccatgactctgtctagtcttgttgatgctctctttcttccatcagcgagaatcgatcctttgaataggttaatgcgctttatgattcattcgggattctttgaaacacgaagccttggcgaaaatcaagaacaacagggatatatactaacaccaacttcaaggcttttagtaaaagctaatcccaagacgatgtcatctgttgttctctctatggtcgatcctatcatggtatcatcttttcaatccttacacacttggtttcagggaagtgaatcctcaccatttgtggctgctcatggtatgagcctatggaatttgttggagcagaatcccgagtctggcaagaacttccatgattcgatggctaatgactcttgcgtgttgatgagtgtaattcttaatgaaggcaagggggtattcaataacttgaagtctctggttgatgtaggaggtgggactggaactacagctcatgccgttgttggagcattcccacacctcaactgcatggttctcgacctcccaaatgttgttgcagacttacaagggactgctaatgtagtcttcattgggggtgacatgttcgagtccatccctcatgcagatgcagtcttactcaagtttattcttcatgattggagcgacaaagattgtgttcgaatacttaagatgtgcagagaagctattccgtcaacagaagagggaggaaaggtgataataatagatgccgtgattgaagaagacaagaagaagaaacaagaagctaaagacgattcaataattactgaaactcaactactgtttgacattatgatgatggcttttgttaatggtaaagagagaactgagaaagaatggaaaaaacttttcatcgactcaggttttaccgactacaaaataactcgtgtccaggggtttaggtccttcattgaggtttatccttaa

SEQ ID NO: 729 - DNA, 1062 bp, Papaver bracteatum
atggatgctgaagaagaaataacgaaagggcaggccgaaatatgggagcatatgtttgcattcgcagattcaatggcgttgaaatgtgcagttgaacttggtataccggatattatcaactctcatggtcatccggtcacagtgtttgagatcatcaacagtttaaaaacaaccacatcatcatcatctcccaacatcgattatcttactcgtgtgatgagattgttggtccgcaaaagtatttttacttctcattttcatcaagaaaccaatcaaatcttgtatggtttaactccttcatccaaatggttattaagagattccaaatttaatctatcaccaacgatttcattttttcttcatccttcaatattgaaaccatggcaatatctaggaaattgtaccaaagaaaatggtcttgcttttcagaaagctcatgggtgtgaaatctgggatatggcggcagctgatcctcatttcaatcaagttttcaatgatggaatgggatgcacggctaagatgatagttagccagatgttgaccgaatataaagatggatttaactgtattggatcgcttgttgatgttggcggtgggaaaggggcgatgatagcagcaattgttgaggctaatccacacataacaggtatcaattttgatctacctcatgtactggctactgcacaagaacatccaggggtcacccatgttacaggtgatatgtttgttgagattccggaagctgatgctgttataatgaagtggataatgcatgactggagtgatgaaaattgcgtcaagatcttgaaaaattgttataaggcaatatcaaagacgaagaatggaaaggttataattgttgattgtgtattgcaaccagaaggaaatggattatttgatgaaacaggagtggcatttgatctactgatgatggtaatcccaggaggaaaagaaagaactgaagtcgaatggaacaacttactgaaaagtgcaggcttccctcgttataatcttatacaaattcccacaatccattctatcattgaggcattcccagaatga

SEQ ID NO: 730 - DNA, 1059 bp, Papaver bracteatum
atggatactgcagaagaaagattgaaagggcaagctgaaatatgggagcatatgtttgcatttgtagattcaatggcattgaaatgtgcagttgaacttggtatccctgatattataaactctcacggtcgtccgatcacaatgtctgagattatcgactacttaaaaacaaacacatcatctctcaacgtcgattatcttacacgtgtcatgcgattattggtgcataagcgtctatttacttctcaacttcaccaagaaaacaatcaaattgtctatggtttaactcggtcgtcaaaatggctactcaaagattctaagtttaatctttcaccgttggttttattcgaaactagtcctcaaccattaaaaccatggcaatatttgggcaaatgcgttcaagaaaatggtttaccttttgagagtgctcatggatgcgggatttgggatcttgctttagctgatcctaaattcaatggaaaattgaatggagcaatgcaatgtatgactatcctgataatcaacgagatgttgactgaatataaaggtggattcaacggaataagatcgattgttgatgtcggtggtggaaccgggacgttgctagctgagatagttggggctaatccacacatacaaggtatcaattttgatctaccacatgtagtgactacatgccctgatatcctaggggttaagcatcttggtggagatatgttcgttagtattccagaagctgatgctgtcatcatgaagtcgcttttgcatgactggactgacgaagactgcacaaaaatcttgaaaaattgttataaggcaataacaaataagaaaaacggaaaagttataatagttgaatttgtgctgcgaccagaaggaaatggcttatttgataaaacaggattgatcttagatatggtgatgttggcacatacttcaggtggcaaagaaagaactgaagtcgaatggaagatgttattaagtaatgccggttttcctcgttataatatccttcaaactcctgcatgtccttgtatcatcgaggcatttccagaataa

SEQ ID NO: 731 - DNA, 1068 bp, Papaver bracteatum
atggatattgaagaagaaagattgaaggggcaagcagaaatatgggagcatatgtttgcatttgcaaattcaatggcattgaaatgtgcaattgaacttggtatgcccgatatcataaactcttatggtcgtccagtcacaatgtccgagatcataaacagtttaaaaaaaaccacattatcatcatctcccaatgtggattatcttactcgtgtaatgagattgttggttcataaacgtatttttgcttctcaatttcatcaagaaagcaatcagattttatatgatttaactccatcatcaaaatggttactaagagattctaaatctactctagcaccaatgattttacttcaccttcatcctctctttttaaaaccatggcaatatgtgggaaaaagtgttgaagaaagtggttttccttttgagaaagctcatggatgtgatgcttgggatctggctttagctaatcctcactttaatcagcttttcaacgatgggatggaatgctcggctaagatagcagtcaacaagatgttagccaactataaaggaggatttaatggtataggagtgcttgttgatgttggtggggggaccgggtcgatgattgccggcatcgtgaaagcgaatccacatattagaggtgtcaatttcgatctacctcatgtagtggctacggcacctgaacatccagggatcacccatgttgggggtgatatgtttgctgatattccagaaggtgatgctattatcatgaagtggataatgcatgattggagcgatgaagactgcataaagatcttaagaaactgctacaaggcaatatccaagacaaagaatgggaaagttataattgttgactgtgtactgcaaccagatcacggaaatggcttatttgatgaagcgggattattattcgatctactgatgatggtaaatacttcgggtggaaaagaaagaaccgaagtcgaatggaacatgttattgaacagtgcaggtttcactcgttacaacataattcaaattcccacattcccttctatcatcgaggcctttccagaatga

SEQ ID NO: 732 - DNA, 1065 bp, Papaver bracteatum
atggatactgcagaagaaagattgaaagggcaagctgaaatatgggagcatatgtttgcatttgtggattcaatggcattaaaatgtgcagttgagcttggcatacccgatataataaactctcatggtcatcctgtcacaatatctgaaatcatcgacagtttaaagaaaagcacatcaacatctcccaacatcgattaccttacacgtataatgagactattggttcacaagaagctatttacttctcaatttcatcaagaaagtaaccaaattgtctatgatttaactcgatcatcaaaatggctactaaaagattccaagtttaatctgtcaccgttggttttatgggaaaataatccgatattattaaagccatggcaatatttgggcaagtgtgtccaagaaaatagttctccttttgagagagctcatggatgtgagatttgggatcttgctttagcggatcctaaatttaataatttcctgaatggtgcaatgcgatgttcgactacaacaataatcaacgagatgttgcttgaatataaagatggatttagtggtatagcaggatcgcttgttgatgtcggtggtggaactgggtcgataattgctgaaatagttgaggctaatccacacatacaaggcatcaatttcgatctaccacatgtagtggctacggcgcctgaatttccaggggtgaagcatgtcggtggtgatatgtttgtcgatattccggaagctgatgctgtcatcatgaagtggacattgcatgactggagtgacgaagactgcacaatcatactgaagaattgttaccaagcaataagaaagaagaaaaacgggaaagtcataattgttgattgtgtattgcgaccggatggaaatgacttatttgataaaatgggattgatatttgatgtgctgatgatggcacacactacagctggaaaagaaagaacagaagcggaatggaagatcttattaaataatgcaggttttccccgttacaatgtcattcgaactccggcattttcttgcatcatcgaggcctttccagaataa

SEQ ID NO: 733 - DNA, 1062 bp, Papaver bracteatum
atggatactgcagaagaaagattgaaagggcaaattgaaatatgggagcttacgggagcagttatagattcaatggcattgagatgtgcagttgaacttggtataccagatattataaactctcatggtcgtccaatcactatttcagagattatcaacagtttaaaatcaaccaaggcatctccgaacgcagaatatcttacacgtgtaatgagattattggttcacaaccgtgtattcacttctcaagtccaccaagaaagtaatcaaattgtatacaatttaactcgatcgtcaaaatggctactgaaagattctaagtttaatctatcacctacagttctatttgatactcatccaataatagtaaagccatggcaatatttgggcagatgtgttcaagaaaatggttttccttttgagagagctcatggacgtgagatttgggatcttgcttcagctgatcctaaatttaataatctcctgaatggtgcaatggggtgtacaagtacaacgataattaacgagatgttactcggatataaagatggatttagtggtataggatcgcttgttgatgtcggtggtgggaccgggacgataatagcggagattgttgaggctaatccacacataataggtaccaacttcgacctaccacatgtggtggctacagcgcctgattttccaggaattaagcatgttggtggtgatatgtttgttaacattcctgaagctgatgctgtcctcatgaagtggatattgcacgattggagtgacgaagactgcacaaaaatattgaagaattgttataaagcaataaccaagaagaaaaatgggaaagtgataattgttgaatgcgtattgcgaccagggggaactggcttatttgataaaatagggttgatatttgatatggggatgttggcacttacttcaggtggaaaagaaagaacggaagatgaatggaagatgctactaaataatgcaggttttccccgctataatatcattcaaactccttcatgtgcttactgtatcatcgtggcctttccagaataa

SEQ ID NO: 734 - DNA, 1062 bp, Papaver bracteatum
atggatgccgaagaagaaagattaaaagggcaggcagaaatattggagcatatgtttgcatttgtagattcaatggcactgaaatgtgtagttgaactaggtatacccgatattattaactctcacagtcgtccagtcacaatgtctgagatcatcgacaatttaaaaacaaacaatttatcatcacccaatgtcgattatcttacgcgtgtgatgcgattcttggtccataagggtctattttcttctcaatttcaccaagaaagtaatcaagacgtctacaatttaactcgatcgtcaaaatggctactaaaagattctaagtttgatctatcaccgtttgttatagtcgaaacgaatccaatattacaaaagccatggcaatacttgggtaaatgcgttcaagaaaatggtttaccttttgagagagcttatggatgtgggatttgggaccttgctttaattgatcctaaattcaataataattttaattgtgcaatgcaatgtatgactatgatgatgataaacgagatgttgatcgaacacaaagatagatttaatggtataggattgctggttgatgttggtggtgggaccgggacgatgatcgcggagatagttaaagctaatcctcatatgcaaggtatgaactttgatctgccacatgtggtggctacagcgcctgatttcccaggggttaaacatgttggtggtgacatgttcattgatattccggaagctgatgctgtcatcatgaagttggtattgcatgactggacagacgaagattgtagaaaaatcttgaaaaactgttataatgcaataacaaacaagaaagatggaaaagttataattgtcgaatatgtattgcgaccagaagaaagtggcttatttgataaaacaggattgatattagacatggtgatgatggttcatacttcaggtggaaaagaaagaaacgaagtagaatggaaggtgttattgaataatgcaggttttcctcgttgtaatattttccagtctcctgcgtatatttgtttcatcgaggcatttccagaataa

SEQ ID NO: 735 - DNA, 1020 bp, Papaver bracteatum
atggaagtagtaaataagattgatcaagaaaaccaagcaaaaatttggaaacaaatatatggttttgcagaatcattagttctgaaatgtgcagttcagttacagattgctgaaacacttcataataatgtaaaacccatgtctttatccgacttagcatctaaacttcccgttcaacctgttaatgaagaccgtttataccgaattctgcgttacttagttcacatgaaactcttcaacaaaaatgctaccactcaaagatattcattagctccaccagcaaagtatttgctaagaggctgggaaaaatcaatggttgcttcaatattaagcgttacggataaagattttacagctccatggaaacatcttagtgacggtttaactggtaactgtaacgcttttgagaaagcgttaggaaagagtattcgggtttacatgagtgaaaatcctgaaaaaaatcaattgtttaatgaaggaatggcttgtgatactggattgtttacctcagcaatggttaatgagtgcaaaaatatcctcagtgacggaatcaatacactagccctggttggcggtggtgctggtactgcagtgaaagccatatctaaagcttttccggaaactaaatgcacaatccatgatcttccacaaattctcagtaacattaataaaacttccagagatttgttcaagtccgttcctagtgccgacgccatctttatgaagagcatccttcacgagtggaacgatgaggaatgtattcaaatcctgaagcgatgcaaagaagcggtaccaaatgggggcaaagttattatcgcagatgtcgtactagacatggattcgactcatccgtattcaaaatcgagactcgcaatggatttggatatgatgctccacaccggtggaaaagagagaactgaagaagattggaagaagcttattgatgctgcaggttttgctagctgtaaaattactaatctatctgctctccaatctgttattgaggcttaccctcattga

SEQ ID NO: 736 - DNA, 1065 bp, Papaver bracteatum
atggaaatcaaactagaagatcaagaacaagaaatgaaaaaccaaggtcatgtttggaacataatctgtggtagtgttgattcatctgtacttaaatgtacagttgaattaggcattcttgatacaattcatcattcatccaaacccatgacactatcttccttatcatcagcatcaccatctttatctacactcaaagccgaaaatttgtacagattattgagatacttatctcatatgaatcttattgctattgattcaactgaaggaaatgagacattttctttgacaggtttatctaaattactacttaagaatcaagaaagaagtttgaaagattgggttctcggtatcgacgatgagcattcgattaatgggtggcatgagttaagtgattattgtttatcggctactgatgcaccgactccatttgtgaaattgtatgggaaaactttatgggaatttgctgcagaagttcctgaagttaatgagctaattaataatgccatggcttgtgatactaggatggtgatgcctgcatttgtgcaaggttgtgacagtatattgaagagtgttaagaagttagttgatattggtggaggcaccggagctgcgatgagttatgttgttaaggcttatcctgagataaaatgtatggcttttgatttgcctcatgttgttgctgctgcaccggaggttccaggcgtggaaatggttggtggagacatgtttgatatcattccctctgctgatgctcttttattgaagttcatgctgcataactggaaagacgccgaatgcataaaactgctaaaaaggtgtaaggaaacaattcctgaagataatgggaaagttatcataatagagatggttttggatcaagatgaagatgatgatgttttgacacaagctagattaagtcttgatctagatatgatgttgagttcaggagggaaagaaaggactaaggatgaatggagaattttacttgaagaagctggtttcaataagattgaattcattcctatttttgctattcaatcagtcattgttgcatatccttag

SEQ ID NO: 737 - DNA, 1122 bp, Papaver bracteatum
atggcaactttgtcttcgaagataacagggcctgaacgagtccttgatgaagggattcatttcgaaagccaagaacaagaaatgaaatatcaagctcaaatttggaaccacatgtgtggtgttgttgatacctcagttctgaaatgtgcaattgaattaggtatatttgatgccattcataactcaagtaaaccggcaattaccttaaccgaattatcaagcgttatttcaagttcaacaccatctgcatcttcaatcgaaccccgcaacttatatagattaatgagatacctatctcaaatgaatctcataagtacagaaaaatgctcggatgaagtaactgtttcgttgacagacacatctaagttactacttagaaaccaagagaagagtttgattgattgggttctgggaatttccagcgaaccgtgcgtgcttgtttggcacgaactaagcagctctctttcaacccctgcggatggacctccaagcttcgagaaggttcacggtaaaaattgttatgaattagctggagaaaatccagagtggaatgaactgattaacaatggtatgactagtgataccagtttaactatgccggcatttatacaaggatgtgatagaatcctcaaaggaattacatcgttaattgacgtcggtggtggtactggtgcctctatggcttacgtcgttaaagcttttcctcacataaaatgtggggtattcgacttaccacatgttgttgaggccgctccgcagtgtcccggtgttgagttcatcggtggtgatgtttttaaattccttcctaatgctgatgctcttttgttgaagtacaccctgcacaattgggaagatccagaatgtgtggatttgctgaagagatgtaaggaagtaattccggcagacaacggaaaggtgatcataatggatttagtaatagaccaagatgataacgatactttgatgcaggcgaggttgagccttgatctcgatgtgttgaaccatggaggtagagaaaggactaaagaagactggagaaatctaattgagatgtctggatttagtaggcatgaaataattccaatatttgcaatgccatcagtgattgttgcttatccttag

SEQ ID NO: 738 - DNA, 1077 bp, Papaver bracteatum
atggatatcaaattagaagatgaagaacaagaaataaaataccaaggtcatgtttggaacatgatctgcggtagtgttaactcatccgtacttaaatgtacgattgttttaggtcttttcgatacaattcataattcatccaaacccatgacactatcctccctatcatcagcatcaccatctttatctcctctcaaaaccgaaaagttatatagactattaagatacttatctcatatgaatctcatcgccatcaattcagttcaaggaagtgatgatacattttcattaacagatacatctaagttactacttagtaatcaagaaagaagtttgaaggattgggttctcggtatcgacgatccactcgcaattaacgggtggcatgagttaagtgattattgtttatcccccgttgatgcgccggttccttttgtaaagatgcacgggaaaaccatgtgggagtttgctgcagaaattcccgaagttaatgagctattcaataactccatggcttgtgatactaaactagtaatgcctgcatttttgcaaggttgccatagtatcttcaataaaggtactgtaaaaaagatggttgacatcggtggtggtacaggtgctgctatgagttatgttgttaaggcttttcccgacataaaatgtatggtttttgatttgcctcatgttgttgctaacgcaccggagattcaaggtgtggaattggtgggtggtgatatgtttgaatttatccctcctgctgatgctcttttgttgaagttcattctccataactgggatgatgtcggatgcataaagctactaaagaagtgtaaggagacaatttcagctgatcatgggaaagttatcataatagaaatggttttggaagaagacgaccatgacaatgatgctttgacacaagcaagattgagtcttgatttagatatgatggtatgttcaggaggaagagaaaggactaaagatgaatggacaactttagtggaacaggctggtttcagcaagattgaattctttcctatttttgccattcaatcagttattgttgcatatccataa

SEQ ID NO: 739 - DNA, 1074 bp, Papaver bracteatum
atggaaattcaaatggaagatgaacaactagaaatgaaatatcaatctcaaatatggaatcacgtatgtggtagtgttaatacatcagttcttaaatgttcaattagtttaggcatttttgatgtcattcatgattcaggtaagtccatgttgactttaactgagttatcaaattcattatcatcttcaaacatgatcaaaacccacaacttatatagacttcttagatacttgagtcatatgaatcttattgccatcagttcgatccaaggaaatgatcatttttctttaactgatttatctaagttactacttggaaatcaagaaaagagtttaaaggattgggccatagggattggtgatgtaaattttgtggcaacttggcatgaaatgagtagctcttgttccaaactcccaggtgacctcacggcttgggaaacagtacatggtaaagagggttacgagttaaatgtggaggatccagaatttagtgaaaggtttgataaggctatgtcaagtgatactacattagctatgcctgcatttatccaaggttgtgatataattatgagtggaattagttcattagttgatgtcgggggtggaatcggtaccgctatgacttatgttgtcaaggcatttcctcatataaaatgtactgtttttgatgtaccccatgtgattcatacagcggcggatccagcaaagtgtcatggtattgagttcattggtggtgatcttttcagcttcatccctcctgctgatgctattttgttaaagttcatgttacacaattgggaagatgaagaatgcaaaaatatattgaaaagatgcaaagaggcaattccggcggacaaaggtaaggtgatcataatggatatagtgttggatgaaaacgcagataatgatgatttagtacaagccaagttgagcatggatcttgatatgatgagttcaggaggtcgagaaaggactaaagaagattggaaaaacctgctcgagatgtccgggtttacaagccatgaaatcattcccattctcgccatacagtccatcattgttgcatatccttga

SEQ ID NO: 740 - DNA, 1014 bp, Papaver bracteatum
atgatgagcattcgattcagattattgagatacttatctcatatgaatcttattgcaatgaatgcaattgaaggaaatgagacattttctttaacaggtatatctaaattactacttaagaatcaagaaagaagtttgaaagattgggttctcggtatcgacgatgagcattcgattaatgggtggcatgagttaagtgattattgtttatcggctactgatgcaccgactccatttgtgaaattgtatgggaaaactttatgggaatttgctgcagaagttcctgaagttaatgagctaattaataatgccatggcttgtgatactaggatggtgatgcctgcatttgtgcaaggttgtgacagtatattgaagagtgttaagaagttagttgatattggtggaggcaccggagctgcgatgagttatgttgttaaggcttatcctgagataaaatgtatggcttttgatttgcctcatgttgttgctgctgcaccggaggttccaggtgtggaaatggttggtggtgatatgtttgaattcattccccctgctgatgctcttttattgaagttcatgctgcataactggaaagacgccgaatgcataagtatggcttttgatttgcctcatgttgttgctgctgcaccggagattccaggtgtggaaatggttggtggagacatgtttgatttcattccctctgctgatgctcttttattgaagttcatgctgcataactggaaagacgccgaatgcataaaactgctaaagaggtgcaaggaaacaattcctgaagataatgggaaagttatcataatagaaatggttttggatcaagatgaagatgatgatgatttgacacaagctagattgagtcttgatctagatatgatgttgagttcaggagggaaagaaaggactaaagatgaatggagaattttacttgaagaggctggtttcaataagattgaattcattcctatttttgcaattcagtcggttattgtggca

SEQ ID NO: 741 - DNA, 1173 bp, Papaver bracteatum
atggctaccaatggcgaaattttcgatacctatggtcataatcatcaaacagccacagtcactaaaatcactgcttctgatgacagcagtaatgatgtctgttatctttcagaaacggctaacttagggaagttaatatgcattccaatggcattaagagctgcgatggagctaaatgtgttccaacttatctcaaagtttggaactgacgcaaaagtttcggcttctgaaattgcctctaaaatgccaaacacgacgagtaacccaacagcagctatctatttagatagagttcttcgactgctcggtgccagttctattctttccgtttctaccagaaaaaaattaatcaacggaggaggagaagatagagtagtacatgagaaggtgtacgggctaacgaattcgtcgtgctgtttggtccctcgagaagaagacggggtgtcattagtcgaagaattgctattcacatctgacaaggttgttgtggatagttttttcaaactgaaatgtgtggtggaagaaaaagacagtgtgccatttgaggttgctcatggtgctaagatctttgagtatgctgctacagaaccaagaatgaataaggtttttaacgatggaatggcagttttctctattgttgtttttgaagctgtttttagagtttacgatggatttcttgacatgaaagaattgttagatgttggtggtggtattggtacttcagttagtaaaattgttgctaaataccctttcattcgcggtgtcaacttcgacttgcctcatgttatttctgttgcccctcaatacccaggggtagagcatgttgcaggagacatgttcgaggaagttccaaagggtcaaaacatgttgctaaaatgggtactgcacgattggggtgacgaacgatgtgtgaagctgttaaagaattgttggaagtcattacctgcgggtggaaaagttttgataatcgagtttgttcttccgaatgaacttggtaataatgccgaatcattcaatgcgttgattcccgatttactcctgatggctctgaatccaggcggtaaagaacgaacaatttcggaatatgatgatttagccaaagcagctggatttataaaaactatacctatccctatctccaatggtcttcatgtcattgagtttcacaaatga

SEQ ID NO: 742 - DNA, 1167 bp, Papaver bracteatum
atgactatggaaattgatcatggtgaagaacatgatacatcagcatcatctactactaacctcggtgatgatgtatcttatctttctgataatgcaaatttaggtaagctcatatgcattccaatggcactaagagctgcgatggagctaaacgtgttccagctcatctcaaaattcgggcttgatgcaaaggtttcggcttctcaactagtctcaaaaatgccgaacgcacccaataatcctaatgcagcaatgtatttagataggattctccgtttacttggggcaagttccattctttcagtttctaatagcatggaaagtggtggtcactgtgttaatcagaataatggagaagctggagcagtagcaatggagagagtgtatggattaacgagggcatcgtattgtttagtgcctcgagaagaagacggagtttcgctagtaccactcttggtgttacaatctgataaggtcatagttgatagtttttttaaattgaaagagatggttatggagaaagatgttgtgccatttgatgctgctcatggtattagcatcttcgagtatgcttgcaaagagccaagattgaataaggcttttaatgagggaatgggagctttctctgctgttgtttttgaagctgtttttaagtactatgatgggttttctgggatgaaagaattgttagatgttggtggtgggatcggtacttccgttagtaagattgtcgcgaaataccattccattcgtggtatcaactttgacttgcctcatgttatttctgttgctcctcaatacccaggtgtggagcatgttcaaggagatatgttcgaacaagttccaaaggctcaaaacatgttgctaaaatggatacttcacgattatgacgatgaacattgtgtgaagttgttaaagaactgctggaactcgttacaagtgggtggaagagttatgataattgagtttgctgttcctaacaaacttgtcaatagtgcagaaacgttcaatccgttgaattctgatttaatgatgatggctgtgaatccaggcggtaaagaacgaacaatgtttgaatttaataatttggccagtgcatctgggtttgcgaaaactgtacatttcttgatctccgaatcacttcacctcattgagtttcataaatga

SEQ ID NO: 743 - DNA, 1122 bp, Papaver bracteatum
atgagttattcgatacccattcatgttaatgaactaaaccatcaagatttagaagaaaatgatgatcaactctgtattttagcatgtcaaattgcagcttgctcaggacttccgatggctttaaaagctgcattagatcttgatttactcgaaaccatagctaaagcgggtccaaatgcatacatctccccattagagatttcatccaagttaggtactcaaaatcccaatgcaccttccatgttagataggcttttgcgtttgttaacaagcttttctatcctcaaatgctcacaaatcactacccaagatggcaagattcaacgactgtatgggttagcacctgtttgcaagtattttactagggatccagaaaatggtgtctctgttgctcctttagctgtgatgaatacagacagggtcttcatagatagttggtatcactttaaagatgctgtaatggaaggtggaattcctttcaatagagctcatgggatgagtgcatttgaataccccgggctagatcttagattcaatcaagtttttaataaagctatgtcagatcacactaccttgactatgacaaaagtacttgaaaaatacaaaggatttgaaggtattaaagtgttggttgatgttggtggtggtgttggagtcacaactaaaatgattactgccaagtatcctcaacttaagggtatcaatttcgacttgcctcatgtattagcagatgcaacaacatatcccggagtggagaatgttggaggagacatgtttgtcagtgtcccaagaggggatgccattttcatgaagtggattcttcacgattggagtgatgagtattgcttgaaactcttaaaaaactgttatgaagctctaccagactgcggaaaagtgatcattattgaagcgaatcttcctgcagtcattgatgatagtgttacctcaaaacttttgtttgaacaagatatggtcatgttaactcagaaccctggaggtaaagaaaggacattttcagaatttgaagacctggcaaagcaatctggatttgctagctgtgagactctatgttctgtttactacagttacgttatggagttccataaaacagctaggatttag

SEQ ID NO: 744 - DNA, 1128 bp, Papaver bracteatum
atgggttcaggccatcacagcaaacacaaaggtgatcatcatgaagaagagcattccaaagataaaaaagaagaacaagcatgtatgtttgcattacaattggctagtgcatcagtaccagtgatggtattaagagctgcaattgaaatggatgttttggaaataatgaacagagctggtccaggttctgaacttagtgctgcatatattgcatcacagattctcaatgttaccaacccgaatgctagtattatgcttgatcgtatgttgagattattggctagttataagattcttacttgttctgacagaactcttgacgatggcacaactgagagagtctatggtcttgaacttgtttgcaagtttcttgtcaaggatgatgatggtgtttcaatggctcctttgcttttgatgaaccaagataagatcttattggagagctggttccatttgaaagacgcggttgtgaccggcggtatcccatttaacctggcatacggcatgaacgcattcgaatacccagcaacagatgcaaggttcaacacggtgttcaacaaaggaatgtcagatcacactgcaattttcatgaaaaagattttagaaacatacaaaggtttcgaaggtataaattccatcgttgatgttggtggaggcgtcggtgtcagtctagacatgattcttaccaagtacccatccatgaaaggtattaacttcgatttaccacacgtaatcaaagacgcgccagcttacgaatccgcagtcgaacatgttggaggagatatgtttgtgagtgttccaaaagggactgatgctgtattcatgaaatggattcttcatgactggagtgacgagttttgcacaaaagttttgaagaatattcatgatgctttacctgaacatggtaaattgatactagtggaatgcattattccaccaacatgtgaaccaactcttgaagctttaggtgtttaccatgttgataatatgatgatggcttacaaccctggtggcaaagaaaggactgagaaagagtttgatgctttggctaaagcaactggattttctggtgttaagcttatctgttctgcttttaacacttggattatggagtgccacaagaactaa

SEQ ID NO: 745 - DNA, 1059 bp, Sanguinaria canadensis
atgggtataaatgataagccagaatctcaagaggttgacatcaaagctcaagctcatctctggagcataatctatggctttgctgattctctagtcctacgttgtgcagtagaaattgggattgcagatatcatcaaaaacaacaatgggtcaatttctgttacagaactctcatcaaaactcccaatctcaaacgtcaattctgataacctgtatcgtgtcttacgatacttggtacacatgggtatcttgaaagaagattcagacaataatggagtcaagctttactcacttcaaccagtagctactctgctcttaagagatgcagagaggagtatggtacccatcattttaggaatgacacaaaaggatttcatggttccatggcattttatgaaggaaggtttaggaaatgggggtactgcatttgagaaagggatggggatgacaatttggcagtacttggaagggcatccagaacagagccagttattcaatgaaggaatggctggtgaaactaggttactgactaaatcacttattgaaggttgtaaggatacatttgaaggtttaacatctcttgtagatgttggaggaggaaatggcacaacaattaaggcaatttatgatgcatttcctcatataaaatgcagtgtttatgatcttcctcatgttattgctagctctcatgatctcccaaatattgagaggattcctggtgatatgttcaagtctattcctagtgcacaagcaatcttactcaagttgatcttgcatgattggactgatgaagagtgtgtcaacattctaaaaaagtgtaaggaagcagtaccaaaagagacagggaaagtgatcatagtggatgtagcactggaagaagagtcccaacatgaacttacaaagacaagattgatacttgatattgatatgttggtgaatactggtggtagagagagaactgaagatgattgggaaaagttgctcaaacgtgcaggctttagaggtcataagatcaggcacattgcagctattcagtctgtcattgaagccttcccatag

SEQ ID NO: 746 - DNA, 1047 bp, Sanguinaria canadensis
atggaagcaaacaagagtgatcaagcaacccaagctaaaatctggaaactcatctatggtttcgctgaatccctagtcctcaaatgtgcagtccaactcgaaatcgccgatacaattcataaccacggcaaacccatgactctatccgagttagcttctgaacttccgattcaaccagtcaactcagacagattatacagagtcatgcgttacttagttcacatgaagctcttcaacaaagaaaaaagcaccattaatggcgaattcaaatactcacttgccccacctgcaaaattcctgataaagggttgggagaaatcaatggtggcttcaattctagcaatcaatgataaggatttcttggctccttggcatcatttgaaggatggtttggttggggattgtgatgtttttgagaaagctttggggaaaagtatttgggtttatatgagtgagaatcctgagaagaatcagctttttaatgaagcaatggcttgtgatacaagattggttacttcagctttggtaaataattgtggaaatgttttccatggaattaaaacacttgttgatgttggtggtggaactggaactgctgtgaaagctatttccaaggctttccctcatattaaatgcactatttatgatcttcctcatgttattgctgattcccctgagattccaaatattgttaaaattgaaggggatatgttcaagtccgttccaagtgctgatgccatcctaatgaagtgtattcttcacgattggaacgacgaggaatgcattcagattctaaagaaatgcaaagaagcagtaccgcgagaagggggaaaggttatcatcgtcgatgttgtactaaacatggactcgacgcatccttattccaagattagatttacattggatttggacatgatgcttaacactggaggaaaagagagaacactggaagaatggaagaagctgattgatgctgcagggtttgctagtttcaaaataactcaaatgtctactgtccaatctgtaattgaggcttatccttattaa

SEQ ID NO: 747 - DNA, 1050 bp, Sanguinaria canadensis
atgcagcaagctcaggctcaggtttataaccatctcttcagctttgtaagctccatgtccctgaaatgtgctgttcaactaggcatacctgacctcatccacaaccatggccaacccatcaccctctccagccttgttgaagctctctctttaccaccgacaaaaaccgattctgtttatcgcctcatgcgcgttttggttcacttgggcgtttttgctagacagaaaatcgatgaaaatcaacaagaggaaggatatgtgcttacaccatcaacaaggctcttactagaagataataccaaaatgtcattgtcgttggtggtcgatatgctaggtcctgttcttgtaaaaccttgggaattgttacgtgcctggttccaagggagtggatcgacggcatttgaggctgctaatggtatgaccttctggaagtacttagagcagaattctgaattcaacaaggccttcaataataccatgggttttgactctcgcttggtgatgagtgcaattgtcaatgattgtaaggcggtattcgagaatttgagttcattggttgatgtaggaggcggcatgggaggtgcggctcaggtcatttctgatgcattcccacacttgaaatgcctggtgcttgacctcccaaatttggttgcagatttaccagcagaaaggagtactaagaacttagactatattggtggcaacatgtttgattccatcccccatgccgacgcagttttattgaagtctgttcttcatgattggagcgataacgactgtgtaaagatactgaagagatgcagagaagccattccgtcgagagaagagggaggaaagttgattataatagagattgtgatggaagacaggaaacaaggacatgaaacaactgaaatccaactttcccttgacatgttgatgatgattctacttgatggtaaagagagaagtgagaaagaatgggagaagctcttctcagagtctggttttactgatcataagatcactcctattccggggtttagatccctcattgaggtttatccttag

SEQ ID NO: 748 - DNA, 1065 bp, Sanguinaria canadensis
atggagatccaattgggagatcaagaacaagaaatgaaatggcagggccaagtttggaaccacatctgtggtagtgttgactcatcagttctcaaatgttcaattgaattaggcatttttgataccattcacagttcaggtaagcctatgatcaccctatctgaattagcaacttctccatccttagtttccatcaaaacccaaaacttgtatagattactaagatacttagcccatatgaatctcataaccatcaatattgtagaaggaaatgaaacattttcattaacagacttatctaaattactccttagagacaaagaaaagagtttagtggattgggctctagggatcgacgacgagacctgtgttaccgtttggcacgaattgagtagttcttgttcgttgccggccgacgcaccaacatcttttgaaaaggttcatggtaagagtatatgggaattagcagaggagaacccaaaattgaaccaatttataaacaatgccatggcaagtgatacaaggttggttatgccagcatttatacaaggttgtgctaaggtcttgaatgaaattacatcattagtcgatatcggcggtggcactggtaccgccatgagttatgttgttaaggcttttcctgaaataaaatgtacggtgttcgatctacctcacgttgtagcctcgtcaccgcagtctccctgtgtggacatgattggaggtgacatgtttgaattcatccctcctgctgattctgttttattgaagttcatgctccataattgggaagacggagaatgcataaaactactaaagagatgtaaggaagcaattccaacagatcaagggaaggtgatcataattgaaatggtgttggatcaagatgaagacgattacgatctaacacaagcgaggttgagtctcgatctcgatatgatgttgagttcaggaggaaaagagaggactaaggatgaatggagagttctacttgagatggctggttttagcaagattgaattcattcctatttttgccatacaatcagttattgttgcatatccttag

SEQ ID NO: 749 - DNA, 1065 bp, Sanguinaria canadensis
atggagatccaattgggagatcaagaacaagaaatgaaatggcagggtcaagtttggaaccacatttgtggtagtgttgattcagcagttctcaaatgtacgattgaattaggtctccttgatacaattcacagttcatcaccaaaacccattaccctttctgaattatcaacttctccatctttatcttctctaaaaacccaaaacttgtatcgattgctaagatacttatctcatatgaacctcataaccattaattttcatgaaggaaatgagacgttttcattaacagacatatctaaattactccttcaaaaccaagagagaagtttgaaggattgggttcttgggatcgacgacgaacactcgattaatagttggcatgaattgagtagctattgtgcttcgccggctgatgcgcctacgccttttgtgaagttgcatggaaaaactctttgggaattagcagaggaggttcctgaagtgaatgaacttattaacaatggaatggcttgtgatacaaggatggtgatgcctgcatttatacaaggttgtgataagatcttgagtggaattacgaaattggtggatgtgggaggcggcactggtgcggccatgagttatgttgttaaggcttttcctcagattaagggtacagttttcgatctacctcacgttgtagcgacggcaccgcagattcctggtgtggagatggttggtggtgatatgtttgaaggcatcccccctgctgatgctcttctattgaagttcatgctccataattggatagacgacgaatgcataaaactactgaagagatgtaaggaagcaattccaacagatcaagggaaggtgatcataattgaaatggtgttggatcaagatgaagacgattacgatctaacacaagcgaggttgagtctcgatctcgatatgatgttgagttcaggaggaaaagagaggactaaggatgaatggagagttctacttgagatggctggttttagcaagattgaattcattcctatttttgccatacaatcagttattgttgcatatccttag

SEQ ID NO: 750 - DNA, 1110 bp, Sanguinaria canadensis
atgggttcaactcagaaccaatttaatgccaccacagaagaagatgaagaagcacaagcttgcatgtatgccatgcaattagccagtgctacagtcccagtgatggttctaaaaacagcagtagaacttgaccttcttgaaattatcaagaaagcgggtccaccaggtacccaaatcagttctacagaaattgcatctcagatcccaaacaacaagaaccctgaatcccctgttatgcttgatcgtatgatgagactcttggctagttacaaaattctcacttgttcattgagaaatcttgatcaagatggtaaagttgaaaggctttatgggcttgcacctgtctgtaaattcttgactaagaatgaagttggatgttcaatggcccctctgcttctcatgaatcaagataaagtcctcatggagagctggcactacttgaaagaagcagttcttgatggagggatcccatttaacaaggcttatggtatgacagcatttgagtaccatggcactgatcctagattcaacaaagtctttaacaagggaatgtctgatcacaccaccataaccatgaacaaaatcttagaaacctacaagggttttgaaggtttaacatccatcgtagacgtcggcggaggcatcggtgccaccgttaacatgatcgtctccaaatacccgacgatcaaaggtattaacttcgatttacctcacgtaatcggagacgcaccatcttatccgggagtcgaacacgtcggcggcgacatgtttgctagtattccaaaaggagatgcaattttcatgaaatggattcttcatgattggagtgatgaacatagtataaagattttgaagaattgttatgaagcattgcctgaaaatgggaaggtgatacttgttgaatgcattattccagtgttgcctgaacccaacaattctgccggtcatggtgtgttccatttagacaatattatgttggctcataaccctggaggtaaagagaggacagagaaggaattcgaagctttggctaaagggacaggatttagtggctttaaagtggtctgttctgcttttgacacttatgtcatggagttatctaaaaactaa

SEQ ID NO: 751 - DNA, 1041 bp, Sanguinaria canadensis
atgcaattagcgagcgcttccgtcccggtcatggttttaaaagccgcggtagaactcgacgtgcttgaaattatagcgaaagctggtccgggtgcgcaaattagtgcttcggatatcgtatctcaaattccgaatgtgaagaacccaaacgcacctgtaatgctagatcgtatgcttagactcttggccagttacaagatcctaacttgctccgttcgggaccttgaagaggatgatggccttgtcaaggagcggctctacggactagcactcgtatgtaaattcctagttaagaatgaagatggatgttccatggctcctttgcttttaatgaatcaagataaggtcttcttggagagctggtttcacttgaaagatgcagttattgatggtgggatcccatttaacaaggcttatggtatgaatgcatttgagtaccaaggcagcgatcctaggtttaacaagatctttaacagaggaatgtctgatcacaccaccataaccatgaagaaaatcctagaaacctacaagggtttcgaagggttgacatccctcgtagacgtcggtggaggaatcggtgtcaccgttgacgcaatcgtttccaaatacccaacaatcaagggcattaacttcgacttacctcacgtaatcgaagatgcaccgtcttatccaggcgtcgaacatgttggcggcgacatgtttgttagtgttccaaaaggagctgatgctatattcatgaaatggattcttcatgattggagtgatgaacacagtatacaaattttgaagaattgctatgaagccttgcctgaccatggaaaagtgataattgttgaatgcattattcctccataccctgaaaccagtctttctggtcttggtgtgtttcatgtagacaacattatgttggctcataaccctggaggtaaagagaggactgagaaagaatttgaagccttggctaaaggaacagggtttgctggttttcgagttatctgttctgcttttaacacttgggttatggagttttctaaaaactaa

SEQ ID NO: 752 - DNA, 1161 bp, Sanguinaria canadensis
atggatgccaacgaagcaacgaacagctgctatatttccgaagcgggcaacttggggaggttgatatgccttcccatggctttgagagctgcaattgaactaaatgtattcaatatcatctcaggattcggccccgaagcccaagtctcttcgcgagatttggtagctaagattccaacaaccaatcctaatgcacatatctttttagaacgaattcttcgtatgctggcagcaagctccttcctatctgtgtcgacgaggcctttatctgcatcatcgccgacacctgtcaatggtcataacggaaacagtattaatggtcatgaatacaatcatgatcataatcatgataaagtaaaagtggtacaggagagggtgtacgggctaacgaaggaggcgcgttgcttggtgcctcgtgaggaggacggagtgtcgttggtgccaatgctgatgtttctggcagacaaagtagtagtagagagcttttataacctgaaagaggtggtgctacaacaagggcgggtgccgtttgatatgactcatggagttagtatcttcgagtacgccggcaaggagccgaggatgaacaaagtgttcaatgaagccatgggagacttctctgtggttgcttttgatgaagtgcttaaggtttacagtggttttcttgatatgaaagagttggttgatgttgggggtggaattgggacttctcttagtaacattgttgccaagttcccactcatccgtggcatcaattttgatttggctcatgttatctctgttgcacctaactacccaggtatagagcatgttgcaggggatatgtttaaagagctaccaaaggcacaaaacattttgcttaagtgggtactacatgactgggacgacgagcagggcctgaaattgctaaagaattgctggaattcattgcgggagggtggaaaggtgatcgtgatagagttcgttatcccttctgaaataggagataatgcagaatccttcaatgctttaacgcctgatctactgatgatggcattgaatcccggtggcaaagagcgaacaatcgtagaattttatgacctcgccaatgctgctggattcgccaaagccaaggctttccccatcgccaagggtctccatgtcattgagtttcataagtag

SEQ ID NO: 753 - DNA, 1194 bp, Sanguinaria canadensis
atgaattcttcatcttccactattaaatcctcaaatattaatattaatgaaagagaatcagattcagaagaagagctttgcctattggcattgcaaatagcaagctgttcagtacttccgatggcattaaagacagcattagaccttgatttatttgaagtcatggctaaagctggtccaaatgcatatctctcacccttagagatatctagtcagttgggcgggactgatcaaaatccagatgcaccagccatgctaggtcgcatcttgcgtctcttaacaaccttctccattctcaaatgctcatcaacacgtacaataaaattattactcaacaagaatgagcagcaagctcatgatcagaacggccaagttgatcatgatgatcagacaacacgtttattctatggtttgggacctgtttgcaagtacttcactcggaatgaagatggagtctcccttgctcctttggctcttttgcatcaagataagcttttaatggacagttggtaccacttaaaagatgttttcatcgaaggtggaataccttttaacagggctcatggaatgagtgtatttgagtacccaggaatagatctcaggttcaacaagcttcttaacaatgcaatgtcaggtcacacaactcttaccatgaagaaagtacttgagacttacaaaggatttgaagatttgaaagagttggttgatgtgggtggtggggttggaatcacaactaacctaattacttctaagtatcctcaaattaagggtactaatttcgacttgcctcatgttttagcggatgcaccgtcttatcccggagtggagcatgttgaaggagacatgtttgaaagcgttccaagaggagaagccattttcatgaagtggatacttcatgattggagtgatgaacattgcttgaaattattaaagaattgttatgaagctctacccaactccggaaaagttatcattgtggagtacattgttccgatggtcatcgacacaagcgtcaactcaaagttcatcttccagctagacctacttttgttatctcaaactaatggaggaaaagagaggacattcaaagagtttgaagccctggcaaagcagtctggatttgctagatgtgagactatatgcactggttaccacagttccattatggagttccataaaacagctaagaattag

SEQ ID NO: 754 - DNA, 1077 bp, Stylophorum diphyllum
atggcattgcaaagtgatgagcaagtgttgcattctcaaactcacatatggaaccatattttcagcttcataaactccatgtccctcaagtgtgcaatccagctagaaatacccgatatcattgaacgccatggtgcaccaatgttgctctcggagttagtagacgccctctccatcaacaaggaaagagccccttttgtctatcgactcatgcgtttacttgtccactccggcttctttgtgaaacaaaaagtatcggaagaaagtgaagaaggctatttgctagctcctgcttctcgctttcttctaaaggaagagccattaagcattagaccttttttactagccatgctcgatccaatagtgatggatccatggcaacacctgagcaaatggttccaaaacaacgatatcaaccctttttacacagctcatgggaagaatccttgggagcttctacgccataagccagagcttattcaattaaccaatgaaggatgggctagtgattcaagacttgttacaagtgtgattcttaagcaatctggtactggtagtgctttttttgaagggttaaattctattgttgatgttggaggtggtactgggacggtcgctaaagccattgctgacgcgtttccaaaactcagttgcattagtttcgatcttcctcaagttgtcaatggtttggttggtggtaagaatctgagctttattggtggcgacatgttccaagagattcctaaagctgatgcagttctcctaaagtggatactacacggatggaatgatgaggaatgcttaaagatattaaagcgatgcaaagaggcgattccaagcaaagaaaatggaggaaaagtgataatcatcgacatggttgtgaaagatcaccaagggccgggtgacgatgaatttatcaaggcacaacttttctttgatatgcttatgatggcatcgcagacgggaagagagcgaaatgaaaaggattgggcaaagctatttcttgatgccggatttagtgattacaaaatcactcacaatttgggatcaaggtctttcattgaagtttacccatag

SEQ ID NO: 755 - DNA, 1080 bp, Stylophorum diphyllum
atgggttctattgctgatcaagaggtgaaggataatgagatgatgcaagttaacagtgacgtttggaagtatacattcagctttataaggtccatgtccctcaaatgtgctattgaattaggcatacctgaaatcatccacaaccatggaaaacccatgactctctccggcctggttgacaatctcgctgtaccaccaacgaaggccgactctttgaatcgtctaatgcgttttttaattcacggaggcttctttgctaaagaaaaacttgatgaaaatcaagaagaggaaggatttgtgctcacacaatcttcacgattcttagtaaaagataataaaaacaccttgtcttctattgtgcttgctatggtagatcctgtcatggcaacacctttgcatttcttgagcaccttgttccgagggaatgaatcctcagcattcgaggccgcccatggtatgagactatggaattaccttgaacagcaccctgaatttggcaagaccgtctatgatgccatggctaatgactctcgcttgtctatgagtgtaattgtcaatgagggtaaggcagtatttgagaatttgaagtctttggttgatgttgggggttgcactggagttgcaactcagaccatttcggaagcattcccacacttgaaatgcacggttcttgacctcccacatgtggttgcaggtttaccaaatagtaagaacttagactttgttggcggtgacatgtttgagtccatccctcgttccgatgcagttttactcaagtttgttctgcatgattggaacgataatgactgcgtaagaatacttaaaaattgcaaagaagctataccatcaagagaagagggaggaaaggtgattataatagatgccgtggtggaagacatgaaacaagaacacgagagaactgaaacccaattactcctagacatatggatgatggttcaattaggtggtaaagagagaactgagaaagaatgggagaaactcttcatagagtctggttttattgactacaagataactccttttgtagggttcaggtccgtcattgaggtttatccttag

SEQ ID NO: 756 - DNA, 873 bp, Stylophorum diphyllum
atgacaaagatgaaggagagactagaggaggatgcaagactgcaagggcaagcagatatatgggatctcatgtttgcctttgcagattccatggtgttaaagtgtgcaatagagcttggtatagcagacataataaattcccatggccgtcccattaccttaacagaaatcattgatgctattagatcgaattctagtgttccctcgactccaaaccacaattatctgtcacgtgtcatgacatttttggttcgtaaacgcgtcttctctgctcaaactcacccggaaaatggcgagactttatataaccttactgcttcttcaaaatggctagttaaagactcggaattcacccttgcatcaatggttctagctcagctccatccatggttgatgtctccctggcactactttaccaaatgtgttcaagaaggcgggatagcttttgaaaaggctcatggatctgagatttgggactttgctttggctcatccggatttcaatgagctttttaatggtggaatggcatgtgcgtctaagatcatagtcaactcgatattggtaacgtataaggagggattgaatggtttaggctcaattgtcgacgtcggtggtggtacggggatggtgataggtgaggtagtgaaggcacatccacatgtacgaggtatcaattttgatttaacccatgtagtagcgtcggcacctgagtatgaaggagtcaggcatgttgctggcgatatgtttgttgatattccacatgctgatgcggtcatcatgaaagtggatggatgtttggttcctacttttttccaagtcagcaagagtatgccatgtatcctatcagattacaagttgagttcgcaatcctga

SEQ ID NO: 757 - DNA, 1080 bp, Stylophorum diphyllum
atgggatctattgaagcagcaataaccaaccaatctaatgaagagaactttacttatgcaatgcaattggttacctccacatcattaacaatggtgttagtaaacacaatcaagctcaaggcttttgaggttatggccgaggcgggatcagatgcccgtctctcagctcatgagatagtgtctcgtttggcgatcacaaaccaagatgctccggagatgcttgaccgaatgcttaggttgcttgcaagccattcaattgtcacttgcactcaaggagactacaagtctagaccagttcgattgtatgggctcactccggttgcgaagtactttatcccgaacgaagatggtgcgtccctaggtgccttgatgcagttgcttcaagacaaagtgttcattgatagttggtttgaacttaaagattcggttgtgggaggaggtattccctttaacaaggttcatggaacacatgcgtttgaatatccggcattagatgcacgattcaatgaggtatttaacaatgcgatggtaaatcatactaccatcgcaatgaagacaattctcgagtgctaccatggttttggcaaccttaaaagtgttgttgatgtcggaggtggtctaggaatcactatcaatatgatcgtatcgaaacatcccactattaaggggattaactttgatttacctcatgtaattcgtcatgcaccgctctatcctggtatagaacatgttggaggagatatgtttcaagaggtaccacaaggtgatgccatttttatgaagtggattctacatgattggagtgatgatcattgtacaaagctgttacagaattgctataaggccctgccagaaaacggaaaggttatcatagtagaggcggttcttccttttgtgccagaaacaagctcttccgtcaaagtaagcacccaaattgacgcgatcatgatgacgcaaaatcctggaggcaaagagcgtaccgaggaggagtttctggcattggctaaaagtggcggattcaagggtataaaaaaggaatgctttgcttgcaacttctgggtgatggaattttataagtaa

SEQ ID NO: 758 - DNA, 1215 bp, Stylophorum diphyllum
atggaagctaaagaagaaggaaggatgaatggatgctatatttccgaagcaggtcacttggggaggttgatatgccttcccttggctctgagagctgcaattgaactaaatgtattcaatctcatctcagaattcggacccaaagctcaagtctcttcgcgagatttggtagctaagattccaacaaccaatactgatgcgcatatctatttagaacgaattcttagaatgctcgccgcaagctccttcctctctgtgtctacgaggactacttcgttaacagcatccaacaccaatggccaccataacagtaacactaatggcggtcatgctcaccaacatgatgagaaaacattcagcactaatggccaccataacggtagcattgatggcggtgatcaccaacatgatgggaaagaaacggagagggtttacgggttaactatggagtcaagttgtctagtgccttgtgacgacgacggagtctcattggtgtcaatgtttatgttcctgtcagataaagtagtagtggagagcttttataacctgaaggaggtggttttgcaacatggacgtgtgccatttgatatgactcatggagttagtatctttgagtatgccggaaaggagccaaggatgaacaaagtgttcaatgaagcaatgggagacttctctgttgttgctttcgatgaggctctaaaggtttacaatgggtttcttgaaatgaaggagttggttgatgttggaggtggaattgggatttctcttagtaacatagtcgctaagtacccactcatccgcggcatcaacttcgacttgcctcatgttatctctgttgcacctaactatccaggggttgagcatgttgcaggagatatgtttaaagagctaccaaaggcacaaaacattttacttaagtgggtactacatgattgggatgatgaaccgtgcctgaaattgttaaagagttgttggaatgcattgccagaaggtggaaaggtgatcgtgatcgagttcgttgtccctactaaaataggagataatgcagaatcgtttaatgcgttaacacccgatctcattatgatggccctaaatcctggtggcaaagagcgaacactcattgaattttatgatctcgccaatgctaccggattcgccgaagtcaagtcttaccctatttctcaaggtctccatgtccttgagtttcataaatag

SEQ ID NO: 759 - DNA, 1065 bp, Stylophorum diphyllum
atgggttcatcagtgttggatgccaagcaggatgaagaagctttcctattcgcgatgcaattagcaagtgcatcagttttgcccatggtgttgaaatctgccatcgagcttgacttgctagagataatagccaaagctggtccaggtgcatatgtatcacctgctgacctagctgctcagcttccgaaactggagaaccctgaggcaccagttatgctcgacaggatatgccgtctgttggctagctactcggtgctgacttgcaaacttgacgagggtgtacgtttatatgggttggcgcctgtgtgtaagtatttggttaagaatgaagatggtgtgtcgaatgcagctcttttgctcatgaaccaggataagatccttatggagagctggtaccatttgaaagatgcagtcttggatggaggtatcccattcaacaaggcttacggaatgactgctttcgagtaccacggaaaagacgacagattcaacaaagtattcaacagtggtatgtacaatcattccaccatgaccatgaagaagatcttggacatctacgaaggtttcgacaaccttactaccctcgtcgatgttggtggtggtaccggtgctagtctcaatatgattgtttctaaacacccttccgtcaagggtatcaatttcgacttgcctcatgtcatccaagatgccgctactcttcctggtattgagcatgttggtggagacatgttcgaaagcgtgcctaaaggagatgccattttcatgaagtggatctgtcatgactggagtgacgcacactgcttgaaatttttgaagaactgctacgcagcactccccgatcatgggaaagtgatagtagcggaatgcattcttccagagacacctgactcgaccctagcgacccaaaacgtggtacacatagacgtgatcatgttggctcacaacccgggaggcaaagagaggaccgaaaaggaatttgaggcgttggcaaagggtgccggattcactggcttccgcaaagcttgttgtgctctcaatacttgggttatggagttcaccaaataa

SEQ ID NO: 760 - DNA, 1056 bp, Tinospora cordifolia
atggaagctgcaactttgaagcaagatcaacaggcccaagccaagatatggaagttcatctatggcttctcagaatcactagtccttaaatgtgccattgaccttgaaatcccagacataattcacaaccatggcacccccatctccctctcccaactctcttctcaaatcgctccggccaagcagcctgtggattctgaccgcttataccgaatcatgcggtacttggttcacatggggctcttcaccgaagagagcatctccggtgagctccggtatggacttgcaccaccggctaagtacctcgtgaaggggtgggagaaaagcgtagtgccctcacttttatgtatcaatgataaggacatgatgtccccatggcactacttaaaggatagcactgttgccggagacaaccggacggcctttgagatggccttaggagtgaatatatgggattacatgggaaagaatcctaagaagaacagtgtgtttaatgaagcaatggcttgtgatactaggcttcttatgtctgcaatggtgaatgagtgtaaagatatgtttcaagggattaagtctctagtggacgttggagggggcactggaactgctgttaggaacattgctaaagcctttcctcacatcaaatgcactgtctttgatctccctcatgttgccgccgattcgccagtttatcccgaagttaaccgcatcgaaggagacatgtttaagggcattccaagtgctgatgccatcctaatgaagtgcatacttcatgattgggacgacaaggaatgcatagagatcctgaagaaatgtaaggaagctgttccggaagatggggggaaggtgatcgtggtggacattgtactaaatgcacactcagatcatccttacacaaagatgaggatggttatggacttggacatgatgttgaactgtggtggcaaagagagaacagaagaggaatggaagaagcttatttacgcagctgggtttagtaggtacaatatcaggcaaattaatgcaattcaatctgttattgagatttacccttga

SEQ ID NO: 761 - DNA, 1026 bp, Tinospora cordifolia
atggaagaagaaaggaatgcacaagcgctagtgtggagatacgcttacggcttcgccgattcgctgactctcaagtgcgcgattcaacttggcatcgcggacatcctccaccaacacggccagcccatgactctctccgagttagcctcatcgctccctctcccaaccgtaaaccaagaccgactccaccgaattatgcgctacctagtccacatgggcctcttcgacctagtcgactcagacacaaaatacgcactcaaccccgcgtcaaccctcctcgtgagaacccaacccaagaacctcgcttctttcgctcttcttcagtactacgagatggacgcgtggcaccacctcagcgccgccgtggaaggccacgtgacgccgtgggagaagtgtcacggcaccgattacagagagtactttgcaaaggacgaggtagcgaatcagttgctgagcgacgccatgacaagtcataccagtatggtgacggaggcgctcgtggaaggttgcaagaagggtaaggtgcttgatggggtccggtcatttgttgatgttggtgggagcaccggcgtggctgctcgcgcggtggccaaggcttttccgtgggtcaagtgtgcggtgtttgacttacctcacgtgattgctaccgcaccggagtgcccgggggtggagaggattgcaggggacatgttcgcgtccgtgcccgaaaccgatgtcgtcttcatgaagtcggtattgcatgactggggagacgaggattgtgtgaagatactaaagaaatgtaaggaagcaattggtgggaagaaggaagggaaagtggtgatattagatatagtgttggatgcaaaatccagtaatgagttcgagggagcgaggctggggatggacatggacatgttggtgactgtgggaggcaaggagaggagtgaggaggaatggaagaagctgttcaaggattcaggttacagtcactacaagatcacccctatagtggccattgaatccattattgaactcttcccttaa

SEQ ID NO: 762 - DNA, 1065 bp, Tinospora cordifolia
gaagaagaagaggaggaggatattaaagctcaagcccagctctggaaacaaatatatggatttaccgagacattcatgctaagatgtgcagttcagctgggaataccagacattatccacgagaaaggacccatgactctaaccgatctagcgagcgagcttcaaatcgtttcaaatgctattaacatggaaagatttggacacaccatgaggttcttggttcacatgaagctcttcacattatctggagaaaacaagtaccaactcactcctgcgtcaaagcttctccttaaagatcccaagcaaaagaagagtttggcttcatatgtgatattgcagacaaacccagaagagttctccttctggggatcttacgtcgacaacttatcatcaggaagctgttcaacaaagtcatattgggaatcaaagtacggggtaaatggcctatacgagttcatagagaaggaagcggatcagaacaagttgatgaatgatggaatgatgagtcatactaaatgcatggttcaagctctggttaatggtctgaagaaggagaaggtcctggaaggtgttaattcactagtcgaagttggaggaaactctggtgatgttgccaaggcaataatagatgtgttcccgtacttgaagtgcactgttatggacttggttcatgttattgaggctgttccaaaagactgccctttgattgattttgtggctggtgacatgtttgatttggttccaagggctgatgctgttttattaaagtctactctgcataaccatgcagatgatgcttgcatcaagatattgaacaagtgtaaggaagcaatagatccaacaaggggcaggctgatcttggtggagatagtagttgacacacaacacttgcaatcagagttcgcatctgcaagattgagcatggacatggatatgattctgttttttgggggaaaagaaaggaccaagcaagagtgggaagaccttttagaaaaggttggatttagtcaccacaagatctatcctattatggcaatggaatcgatcattgttgcatacccatga

SEQ ID NO: 763 - DNA, 1050 bp, Tinospora cordifolia
atgaaatggcaagcccaagtatggaatcacactgctggtggctttgccgattccatagttctcaaatgcgccatcgacctcgccatctttgacaccatccacagccacatttgcaaacaaggcaaacaaatgattaccatctccgaactagtttcatctcctaacttgtcttccattaacacccacaaattatatcgtcttctacgctacttggctcacatgaagctccttgcagttcaagtaattgacggtggagaagaagctttctcactaacagaactatcaaagttcttagttagagataatgagaagaacctagtggattgggcagttgggatccttgacatgcctgccatgaaagcttggcatcaacttagcagctgcatgtcttatccaagcagtgggccgacaccgtttgagaaggaacacgggaagagcgtgtgggaatttgctagggacaaccctgagatgaacgaggtgttgaacaatgccatggaaagtgacacgaggtttttcatgccagcatttgtagaaggttgcaaggggattttgaagggaattgcctcgttggtagatgttggtggtggcacttgtgctgctatgagttatgttgttaaggcttttcctcatatcaagtgtgcagtactggatcttccccatgttatagcaacatcgccagagtatcctggggtagaaatggttgcaggagacatgtttgaatcgattcctcccgcagatgccgttttattgaagtttatgcttcacaattggcaaaatgaaggatgtgtagaaatactaaagaagtgtaaggaagcaattccaaaggacaagggaaaagtgatcataatagatattgtgatagaccaagatgaagaagggaatgatctaacaaacgcgaggattcgtttagatgtggacatgatggcaacatcaggagggcgggaaaggacaaaagaggaatggagagtgttgatggaaatggctgggtttagtcgacatgagataattcccattttctccgttcaatccgtcattgtagcttattattaa

SEQ ID NO: 764 - DNA, 1074 bp, Tinospora cordifolia
atggccaccaaagaaggatcatcagaagtaaactaccttggagggctaggcctgggccgcttgatatgcattccaatggcattacgagccgcagtggaccttaaagtgttcgaaatcatagcagaagcaggcgaagaagctcacctttcttcatctcaaattgcttcaaaactccccacaaccaaccccaccgcccccatcgttctggatcgaatcctcagaatcctcggcgccagctcgcttctctccgtcaagatcgtcaagaaccaaaacgacggtcacgttagggcttacgggctgacaagcgagacccgaagcttggttcctaacaaagaacaagtctcggcagtgcccatgttactgctagtatcagacgaagctgttgtgaagagcttttatgggttgaagcatgcggttttggaagaagggtgcgtgccgtttgacaagttgcatggcatgaacttctttgagtatgcagggaaggaggatagggtgaacaaggtgtttaatgatgctatgggggtgagttctagtattgcttttgatgaagtttttaaggtttatcaaggttttaacgaggttgaagagttgttggatgttggaggaggcattggtacttctctttgtaagattgtttgcaagtatcctcagattagtgggattaactttgagttgagccatgttgttgctgatgctccgccttaccctggagtgaagcacgtggccggaaacatgtttgacggcatcccagaaacgcaaaatatcatgctcaagtgggtgcttcatgactggggtgacgagtattgtgcaaagatactgaagaattgttggaatgctttgccaaagggagggaaggtgattgtggtggaatttgttcttcctccagtgcttggaaataatgttgaaacattcaactctctcatccctgatctcattatgttgaatttgaaccctggaggtaaagagaggaccttggttgaatacgaagatcttgcaaaagcagcagggttttcagaaatcaagccttttcgaatttcacaaggccttcacgtcttggagttcttgaaaaactaa

SEQ ID NO: 765 - DNA, 1098 bp, Tinospora cordifolia
atgacttcaacccatacacttcctaatagcaaccatgaggaagaagaagaagaagactgcttattagccttgcaattggcaagttctgcagtcctacctatggcatttcaaactgcgattgaacttcaagtgctggaaattatttcgaaagcaggctctggtgtttatctttctcctaaagagatagcatctcaactacccacacaaaacccagaagcaccatcgatgctggatcgaattatgcgccttcttgctgcctattctctgatcacttccaccgtggtgacttgtgacaatggcctagtagaaaggaaatatggtttagcacctgtttccaagtattttgtttcaaatcaagatggagtttcattttctccaatcatgtttttagttcaagacaaggtcttcatggatagctggtactccttaaaggatgccgttcttgaaggggggattcctttcaacaaggttcatggagtgcatgcatttgaatacagtggactagactcaagattcaatcaagtatttaataaagcaatgttcaatcacaccactattattatgaaaaaaattcttgaagtgtacaaggggtttgagaatcttgaagagttggtagatgttggaggcgggattggaaccgtaatcagtatcattacttctaagtacccaacagttaagggaattaactttgatttgccacacgttatagaaagtgcttcagttattccaggagtgaagcatgtaggaggagatatgttcactggtgttccaaaaggagaagcaattttcatgaagtggatacttcacgattggagcgatgaatattgcttgaagttattgaagaactgttatgatgcgttgcctagtaatggaaagttgatagttgtagaagctattatgccagtaactccaaagagtaatgctgctgctaaaggcctttgtcaagtagatttagtcatgttgactcaatatgctggaggcaaggaaaggactgagaaagagtttgaagccatggcactaggaactggttttgcgggtattaggaaagtgtgttgtgtttgtaactactgggttatggaatttttcaaagagatatga

SEQ ID NO: 766 - DNA, 1101 bp, Tinospora cordifolia
atgggctcaacccaaaaccaagtatccaagttctcttcaccggaagaggaagaagaagcttgcttgcacgctatgcaactagccagtgcatccgtgttgcccatggtgttgagagcagcaatagagcttgatgtgcttgagatcatagccaaactatcggcttcaggggcttccggccatgtttcggttcccgagattgtggccctgctccccagccaaaagccagaggctagcaaggtgatgcttgatcggatgttgaggttgttggctagttataagatcttgatttgctcgatgggggataacggtgagagaagttatgggctcgcacctgtggctaagttcttggtgaagaatgatgatggggtttccatggctcctcttgtgctcatgaaccaggacaaggtcctcatggaaagctggtatcacttgaaggatgcagttcttgatggaggaattccatttaacaaggcttatggcatgactgcattcgagtaccatggaaaagatccaagattcaacaaagttttcaatcggggaatgtccgaccattccaccattacaatgaaaaaactcctcgagacgtacacagggttcaatggattgaaatcggtggtcgatgtaggcggaggaatcggcgccactcttaacatgatcatctcaaagcatcctaccattaaaggcatcaactttgacttgcctcatgtcactgaagatgcaccatcttatcctggtgttgagcatgttggaggagacatgtttgtcagtgttccaaaaggagatgctattttcatgaagtggattctccatgattggagcgatgatcattgtgcaaaattcttgaagaattgctatgaatcattgccaaaagatggaaaggtgatcattgtggaatcaattctaccagaattcccaaatacagatctctctgcaaacggaagcttccaactggacaacatcatgttggctcacaacccaggagggaaagagagaacagcaaaagattttgaggccttggcgaagagggcaggctttgcccattttaaagttgtttgtggtgcatacaacagctgggtcatggagttctgtaaaagtctgtga

SEQ ID NO: 767 - DNA, 1095 bp, Tinospora cordifolia
atggatttgttcaaaaatcagcccaagaattatgatgaagaggaagattgttgtcagtttgccttgcaattatcaagtgcttcagttcttcctatggtcttaaaagcagtgattgagcttggtgtactagaaataataggaagagcaggtttaggagcacagctgtctgcttctgagatagtttcaagtctacccactaaaaatccccaggcaaccctcatgcttgagcgaatgctgcgccttcttgctagctattctgtgctcactaactctctaaattacagtgaaaatggtgaagtcctgaggttttatggtttgggacctgtttgcaagtacttcatcggaaacaatcatggcgcttccttggctccatttcttcatttgattcaagacaaggcaatcatggagagctggtatcatttgaaagatgctgttctcgaaggaggacttccatttaccaaagctcatgatctgaatgcaacagattacctcaaaaaggactctagattcgccaatcttttcaaacaatattctgtgggtaacaatgttacaaccatgaagaagattcttgacaattacaagggatttgagaatttgaaagaactagtcgatgttggtggtggagatggaagtgttcttgacatgatcgtttctaagtacccttcaattaagggtatcaatttcgatacacctgcagtgattgaaaaagcaccattctatccaggtgtggagcatgttgctggagatatgtttgaaagtgttcctaaaagcaataccattttcatgaagtgcatacttcatggttgggatgatgaaagctgcttaaaattgctgagaaattgctacaaggcactgccagatgatggaatggtggtggctgtggagtatgttattcccacaacctctgagtcgatttcgagaaataataatatcatattgtacgatgcgtttatgatgactgttaatgcactgaagcagaagacactcgaagaatatgaagtcatagcaaaagaagctggattttctggtgttaaattgatttgttatgcttgcaactattctgtcctggaaatttacaaaaactatgtgatatag

SEQ ID NO: 768 - DNA, 1047 bp, Thalictrum flavum
atggcggctttccaaggaaaggatgaatctgtagacatcaatgctcaagctcatgtatggaaaatcatctatggatttgccgattcccttgttcttcgatgtgcagtggaacttggcattttcgatatcattgacaacaacaaccagcctatcacacttgccgatttggcatccaagctccccatatccaatgtcaatttggataatctgtttcggattttacgttacctagtcaaaatggaaatactgagttatgcaggtgtgaataaatacgcgcttgaaccaattgcgaaattggtccttaggaatgaaaaaaggagcatggttccaatggttcttggaatgactcagaaagattttatgactccatggcattcaatgaaagatggtttaactgacaatggtgttactgcttttgaaaaggccatgggcatgactatatgggaatacttagaaggacatccagatcaaagccaactattcaatgaaggcatggcaggtgaaacaaggcttctgacatcttcacttatatctggaagtaaagatttgtttcaaagtattgatgcagttgttgatgttggtggtggaaatggtactactataaaagcaatttctgatgcatttccacatatcaaatgtaccctttttgatcttcctcatgtcattgctaattcatatgatcacccaaatattgaacgtattggtggtgacatgttcaaaggcatgcctagtgctcaagccatcttactaaagctaattttgcacgactggaacgacgaagacagtatcaagattctaaagcaatgcagaaaagcagtaccaaaagatggagggagagttataatagtggatgtagcattggatgaagattcagaccatgagctaagcagtacaagattgattcttgatatagatatgttggtgaatactggtggtaaagaaaggactaaggaagattgggagaagctggttaagtgtgcagggtttagtggttgcaaaatcagacacattgcagctatacaatcagtgattgagattttcccataa

SEQ ID NO: 769 - DNA, 1026 bp, Thalictrum flavum
atggaagacctctcatcacaagctaaactatggaactacatctatggttttgctgattcactagttctcaaatgtgcagtccaacttgatctagccaacttaattcatgaccatggcacccccatgactctttctgagttatcttcacgtcttcctagtcagcctgtgaatcaagatgctttgtatcgagtcatgcgttacttggtccatataaaactattcaccaaatcatcaatagatggtgaattaagatatggtcttgcaccaccagctaaattcctagtgaaaggttgggataattgtatgattggttcaattctattgatggttgatacggattttatggctctgtatcattatatcaaggatgagatattgaacgatggtagttccataaccattaccgcttttgagaaggccttggggactaatatttgggagtacttggcagagcaccctgagaaaaatcagctatttaatgaagggatggctaatgagagtaggctgtattgcagcagtacttttgaaggtttaactacacttgtggatgttggtggcggtactggaactactgtgaagtatattgctaaagcatttccaaatattaagtatactgtttatgatcttcctcatgttattgctgatgcccctggagacactgaaatcaattttgtccaaggagatatgttcaaatacataccaaatgctgatgctatcttgatgaagggcgtccttcatgattgggacgataacgaatgcattgaaatcttaaagagatgcaaacacgcagtgccaagagatggagggaaagttataattattgatgttgtgttaaatgtgaaatcagaacacccttacactaaaatgagattgactttggatttggacatgatgctcaacaataaaggaaaagagagaaccgaagaagattggaagaagctcatttatgatgatgcaggatacaaaggatacaaaataacacaaatatctgctcttcagtcagtcattgaagcttatccttattag

SEQ ID NO: 770 - DNA, 1149 bp, Thalictrum flavum
atgtatataaatgcttattcaggcatgtttgggggtagaagtcgaacactgcataggtatatgatggagatcatgaatgaggatgcatcaaaagaattacttgaagctcaagctcatatatggaaatatacattcaattacataactaccatgtcactcagatgtgcagttcagttaggcattccagatatcatctacaaccacaccaaacctatcaccctttcagaattagtgaaggcactttcaatcccccaaattagatctccttatgtttaccgcctcatgcgcatgttggttcactctggcttctttgcgattgaaaaaattcatgaacatctagaagaagaagaagaaaaagaagggtatacgctgacaccttcatctaggctcctttcgaagaataatgtgacaaacttatcacctttcttgttaatcgaaacagatcctgccattgtaacaccttgtcattttatgagtgccttgttccaggggagtggatgcctcccagtggaggctgcttatggaatgagcatatgggaatacttcctcaaaaaccctgagattaacaagacctttaatgatggaatggcttgtgatgcacaatttctaatgacttttgtaattcaagattgcaagacgatgttcgagggatccaaatcactagtagacgtagggggtggcacaggagcggctgcaaaggctatttctgaggctttcccaaacatgaaatgtatagtttttgatcttccacatgttgtatccaacttaaaaggcaatgaaaatattgaatttgttgctggagatatgttcgagtctatcccttcaacagatatgatcctgcttaagtggataatgcatgactggagcgatgaggagtgtgtgaagatactaaagaaatgcaggaacgcaatcccatcaaaagaccaaggagggaaagtgataataatagacatagtactactggcagaaaaagggaaatatgagtcaactgaatctcaactctgcttggacattttgatgatggttcatgctactggaaaagagagaactgagacagaatgggagaaactatttctggaagctggctttgcaagttacaagattactcatgctttgggtttgaggtctattattgaagttttcccttaa

SEQ ID NO: 771 - DNA, 1053 bp, Thalictrum flavum
atggaaatgatcaacaaggaaaacctctcatcacaagctcaactctggaacttcatctatggttttgctgattcactagttctcaaatctgctgtacaacttgatctagccaacataattcataaccatggcacccccatgactctttccgagttatctttgcgtcttccaagtcagcctgtcaatcaagatgcattgtatcgagtcctgcgttacttggtccatatgaagctattcaccaaatcatcaatagatggtgaattaagatatggtcttgcaccacctgctaaattcctagtaaaaggttgggataaatgtatgcttggtgcaattttaaccatcactgataaagattttatggctccatggcattatcttaaggaaggaatattgaatgatggtagtaccagtaccgcttttgagaaggccttggggactaatatttgggactacatggcagagcaccctgagaaaaatcagctatttaacgaagggatggctaatgatactaggcttattatgtcggcattagtgaaagagtgcagcagtatttttgaaggtataactacacttgtggatgttggcggtggtactggaactgctgtgaggaatatcgcgaaagcatttccacatattaagtgtactgtttatgatctacctcatgttattgctgattcccctggctacactgaaatcaattctgtccaaggagatatgttcaaatacataccaaatgctgatgctatcatgatgaagtgcatccttcatgattgggacgacaaagaatgcattgaaatcctaaagagatgcaaagatgcagtacctagagacggagggaaagttattatcattgatatcatattagatgtgaaatcagaacatccttacaccaaaatgagattgactttggatttggacatgatgctcaacactggaggaaaagagagaactgaagaagagtggaagaagctcattcatgttgcaggatacaaaagatataaaataacacatatatctgcagttcaatctgtcattgaagcttatccttattag

SEQ ID NO: 772 - DNA, 1056 bp, Thalictrum flavum
atggaaatggtcaacaaggaaaacctctcatcacaagctcaactatggaacttcatctatggtttttctgattcattagttctcaaatgtgcagtgcaacttgatctagccaacataattcatgaccatggcagccccatgactctttctgagttatcttcgcgtcttccgagtcagcctgtcaatcaagatgctttgtatcgagtcatgcgttatttagtccatatgcagctattcactgaatcatcaatacatggtgaaatgagatatggtcttgcaccgcccgctaaattcctaataaaaggttgggattactgtatgattgatgatattttagcactgcttgataaagattatatggcaccatggcatcatcttaaggatggattatcgagtgatggtggttcccctaccccttttgagaaggttatggggacgaacatttgggactacatggcggagcgccctgagaataatcaccaattcaacgaaggtatggctaaagatacaaggcttactatgtcagcgttactgaaagaatgcagcagtgtgtttgaaggtataaccacacttgtcgatgttggtggtggtactggaactgctgtgaggtatattgcgaaagcatttccccatattaagtgtactgtttatgatcttcctcatgttattgctgattcccctggcgacactgaaatcaattttgtcgaaggtgatatgtttaagtgcataccaaatgctgatgctatcttgttgaagtgcatccttcatgattggaacgacaacgaatgcattaaaatcctaaagagatgcaaagatgcagtcccaagagacggggggaaagttattatcattgatatcatattagatgtgaaatcagaacatccttacactaaaatgagattactgtgtgatttgggcatgatgctcgacaytggaggaaaagagagaactgaagaagagtggaagaagctcattcatgacgatgcaggatacaaaggatataaaataacacaaatatctgcttttcaatctgtcattgaagcttatccttattag

SEQ ID NO: 773 - DNA, 1077 bp, Thalictrum flavum
atggccaccatcactcccaatacagttttaaaaccatttgagaaggacgaaatcgaagctcaagctttagtatggaaacacatgtatggttttgcagatactatcatgttgagaaccgtagtgagccttggaatacctgatattgtttacaaccatcatggccccatcaccttatctcaattagcaactcagctatcaattgattccattaggaatgacagactcaatatttttatgagatatgcagtgcacatgaatctcttcaaaatttctactgatgagatcacaaaggaaagcaggtatgaattaacacatgcatcgaagatcctagtaaaaagtcacaacaagagtttggcctcctatgtgatgttgcaaacagactctgaagagttttcaatatggggtcatgtagttgattgtttagagggtaaaatatcttacttggaatccacttatggtaatttgtatgaggcactcgaaaaaggtccagagagcgacattgagctttttaatgatgcaatgacaagccatagtagattcatgctccctgctcttgtatctggtttggtgaaggagaaggttcttgatggagttggttcaattgtggatgttggagggggctcaggggttactgctaaggcaattgtacatgctttcccacatataaagtgtagcgttatggacttaaatcatgctatagacagtgtcgtcaaggatccaaagatagatttcgtggctggagacatgttcacttctattcctaatgctgaggcaattttattgaagtccacactacacaaccatggtgatgatgactgccacaagatcttaagcaatgctaagcaagcaataccatctgtaggaggaaaagtgatcttagttgatattgtagttgacattgaaggcctgccagagttttcttcggcaagattgagtatggagatggaaatgatgtttatgggaggaaaagaaagaacaaaacaagaatgggaaactctgttaagcaaggctggttttagtcaccataagatcatacctatattagctatcgagtcaattattgttgcatacgcttaa

SEQ ID NO: 774 - DNA, 1089 bp, Thalictrum flavum
atgggttcaactcaaaagaaccacaacctcactccagaagaagaagaagaagcatgtgtacatgccatgcaattagctagtgcatcagtcttacctatggttttaaaagcagctatagaactagatgtgttagaaattattgctaaagctggccaaggtgcatatgttgctcctactgaaattgcatcccaattatctaccagtaactcacaagctcctattatacttgatcggatcctaaggttgcttgctagttacaaggtcttgacttgcaatttgcgcactttggaagatggtggtgttgaaagattgtatggacttgctcctgtttgtaaatttttggttaagaatgaagatggtgtctctatagctcctttggttctcatgaaccaagataaagtcctcatggaaagctggtaccacttgaaagatgcagtacttgatggtggaattccatttaataaggcatatggaatgacagcgttcgagtatcatggtacagatcctaggttcaataaggttttcaacaggggaatggcagatcactctactataactatgaagaagcttcttgaattgtacaaggggtttgagggattgaaatctgttgttgatgttggtggtggaactggtgccacaattaacatgattgttactaagcacccaacaatcaagggcattaattttgacttgcctcacgtgattgacgatgcaccagcctatccaggtgtagaacatattggaggagacatgtttgttagtgttccgaaaggggatgctattttcatgaagtggattcttcacgattggagtgacgagcacagtgtgaaatttttgaagaactgttatgaatcaatacctgcagatggaaaagtgattatcgtggaatccattctccctgtatatcctgagactaatctcgcgtccaatgcttgtttccaacttgataacatcatgttggctcataatccaggaggtaaagagagaacagaaaaagacttcgaggctttgtctgctaaagctggatttactggtttcaaaattgtgtgcggtgctttcggcagttgggtcatggaattctgtaaatag

SEQ ID NO: 775 - DNA, 1068 bp, Thalictrum flavum
atggctctccaagaaggtgttaattatctatcaggtttaggcttatcacgcttaatatgtcttccaatggcattaagagcagcaattgagttaaatgtttttgaaatcattttccaagctggacctgaagctcaactttctccagcagaaattgttgcaaaaattccaacaaaaaatcccaatgcagcaattgctttggatcgaattcttagaatgctcggtgctagttctatcctttctgtcaccacgatgaaagacggaagagtctatgggttaacagaggagtcgcggtgtttagtagctgacaagaacggagtttctgtggtacctatgttgttattcacttctgataaggctgttgtggagagtttttacaacattaaggatgttgttcttgaagaaggggttataccatttgataggactcatggtatggattttttcgcgtatgctggcaaggaacaaagtgtgaacaaatcatttaaccaagctatgggagctggttcaactattgcatttgatgaagtatttaaggtttataaaggctttcatgatttgaaagagttggtagatgttggaggtggtattggaacttcacttagtaacattatttctaagtacccacatattaagggtattaactttgagttgcctcatgtcatagctgatgcacctaattaccctggtgtggagcacattgcaggtaatatgtttgaaggagtaccaaatgcacagaacattttgctcaaatgggtacttcatgactgggatgatgagagaagcataaagatactacaaaactgctggaaagcattgcccgagggtgggactgtgatcgtagtcgaatttgttcttcctcaaatactaggaaacaatgcagaatctttcaacgcattgactcctgatcttcttatgatgactttaaatcctggtggtaaagaaaggacaaccactgaatttgatggtctagctaaggcagcaggatttgctgaaacaaagttctttccaatttctcaaggccttcatgttatggaattccacaaagcaactgctggtgtagcatcttaa

SEQ ID NO: 776 - DNA, 1053 bp, Xanthoriza simplicissima
atggctttccatggaaaagatgatgctctggacatcaaagctcaagctcatgtgtggaaaatcatctatggttttgcagattctctagtcctccgatgtgcagtggaacttggaatcgtcgacatcattgataacaacaaccaacccattgcacttgcagatttggcctctaagcttcctgtttccaatgtgaattgtgataatttgtatcggatattacgatacttggtgaaaatggaaatattgaggctggaaaattctgatgatggtgagaagaaatacgcacttgaacctattgcgacattgctttcaaggaatgcgaagaggagtatggttccaatgattcttggaatgactcaaaaagattttatgactccttggcattcaatgaaagatggcttaagtgacgatggtactgcttttgagaaggccatgggaatgactatatgggagtacttggaaggacaccctgatcaaagccaattattcaatgaaggtatggctggcgaaacaaggcttctcacatcttcactcatatctggaagtagagatatgtttcaaggtattgactcacttgttgatgttggtggaggaaatggtactactatcaaggccatttctgatgcatttccacacatcaagtgcaccctctttgatctccctcatgtcattgccaattcctatgaccatcctaatattgaacgcattggtggtgacatgtttaaatctgtgcctagtgcccaagctatcttactcaagctaattttgcacgattggaatgacgaagactcgatcaagattttaaagcaatgcagaaatgcagtgccaaaagatggagggaaagtgattatagtggatgtagcattggatgaggagtcagaccatgagcttagcagcacacgattgatacttgatatcgatatgttggtgaacactggtggtaaagagaggactaaagaggtttgggagaaaattgttaaaagtgcaggattcagtggttgcaaaatcaggcacatagcagctatacaatcagttattgaggtttttccatag

SEQ ID NO: 777 - DNA, 1065 bp, Xanthoriza simplicissima
gagatcattaaaggtgatggaacgaaagaggtacttgaagctcaagctcatatctggaactacacatttaactacataacttctatgtcactcaggtgtgctgttcaactaggcataccagatatcatcgacaaccatgacaaacctgtcaccctctctgagttggtgaaggcactttcattccctcaggtgaaatctgctcacgtttaccgcctaatgcgggttttggtgcactctggcttcttcactgtaggaaaaattcatgaacaagaagaggagtatatgttgacgccttcgtctaagctcctaatgaagaaccatgtgacaaacttagcaccattcctattaatgatcactgatcctgttattgcaaattcttgtcacttcatgacttccttgttccaggggtctgaggttttaccgattgaggttgcccatgggatgagtttatggaattactgtaaccaacaccctgaatttaaccagttgtttaatgatgcaatggctagtgacacaaatttcgtgttgagtgtagtggttaaagagtataaggcaatttttgaaggttttaggtccctagttgatgtagggggtggaataggaactgcagccaaggctatttcaaaggctcttccacacttgcgatgcacggttcttgatcttcctcatgtagtctcaaacatggtagggaatgcaaacatagaatttgttagtggcgacatgtttaaatatgttcctcccgctgatatagtcctgctgaagtggattatgcatgattggaatgatgaggaatgcgtgaagatactacaacgatgcagggaagcacttccggcaaaagaaaagggagggaaggtgattataatagatgtagtggtggactgcaataaaggaaagtttgaaacaactgaagcacaactttgcttcgacatattgatgatggtttgtcttactggaaaagagagaactgagaaagaatgggagaaattattcatggaatctggttttacaagttacaagataactcatggtttgggtttgaggtctattattgaagtattcccttaa

SEQ ID NO: 778 - DNA, 1071 bp, Xanthoriza simplicissima
atggagatcactaatggggatgaaacaaatgagctacttgaagctcaagcacatatatggaaccatacatttaactacataacctccatgtcacttaagtgtgcagttcagttaggcatacaagatatcatcttcacccatgacaagcctctaaccctctcagagttgacgaaggcactttcaatccctgagataaaggctgctcacatatttcgccttatgcgcatattggtgcacactggtttctttggtgtggaaaagattcatgaagatgaagaaggatatgtgctaacgccatcatccaagctcctccttaagactcatgagacaaacttgtcgcctttcttactgatgatgatagatcctgtctttgtaacaccttttcacttcatgagtgcctggatccaggggaatgattctacaccgtttgtggctgcctttgggatggaaatatgggattactttggccaacacttggatactactaacaagttctttaattctgcaatggctagtgatgcagcgtttgtgatgagtgtggtggtaaaagattgtaagtcgatgtttgaggggtttagatcattggtggatgttggaggtggaacaggtactatggccaaggctatttcgaaggcattcccccacttgagatgcactaattttgatcttcctcatgtaatctctaacatgcagaggagtaagaacttggatttcattggaggtgacatgtttgagtctgtaccttctgcagatataatactactcaagtggataatgcatgactggagtgatgaggaatgcgtgaagatactaaaacgatgcagggaagcaattccattgaaagacaaggaagggaaaattattataatagacatagtaatggatgacaaaaatggaaaacatgaatcaatagaaacacaactctgcttcgacatgttgatgatgtctttggccactgggaaagaaagaactgtgattgaatgggaaaagctcttcctagagtctggtttcaggagttacaagataactcattgtctaggtttaaggtctattattgaagttttcccttga

SEQ ID NO: 779 - DNA, 1044 bp, Xanthoriza simplicissima
atggaagtgaagaaggacaatctctcatctcaagctaaactgtggaacttcatttatggttttgctgaatcactagttctcaaatgtgcagtgcaacttgatcttgccaacataattcacaacaatggcacccccatgactctttccgagttatctttgcatcttccaaaccaacccgtcaatgaagacgccttgtatcgaattatgcgttacttagtccacatgaagctattcacaaaagaatcaatagatggagaactaagatatggacttgcaccaccagctaagtttcttgttaagggttgggataaatgtatggttggctcaatattagcaatcactgataaagatttcatggcaccatggcattatcttaaagatggattatcaggtgaaagtggtacagcttttgagatggccttggggaagaatatatgggagtacatggcagagcaccctgagaaaaaccagctatttaatgaagcaatggctaatgattcaaggcttattatgtctgcattggtgaaagaatgtggatatatttttaaagggataactacacttgtggatgttggtggtggtactggaactgctgtgaggaatattgccaaggcatttccacatataaagtgtactgtttatgatcttcctcatgtcattgctgattcacctgggtactctgaagttcattgcgtggaaggtgatatgttcaagttcataccaaaggctgatgctatcatgatgaagtgcatacttcacgactgggatgacaaagaatgcattgaaattctaaaacgatgcaaggaggcggtaccgatcgaaggcgggaaagtgattatagtcgacattgtcttaaatgtggaatcagaacatccttataccaagatgagactgacattggatttggacatgatgctcaacactggaggaaaagagaggactgaagaagaatggaagaatctcatccatgatgcagggtacaaaggttataagataacaccgattactgctgtacaatctgtgattgaggcttatccatattag

SEQ ID NO: 780 - DNA, 1071 bp, Xanthoriza simplicissima
atgatgcagatccaagaggaagaacaagagcaagatatgaaaagccatgctcaaatattgaaccatatgtgtggcattgtagattcagtagttcttaaatgtgctattgaactaagtctctttgatatcattagtaacaacaaagataacaaacctataactctctcttcattagcaacatctccaaccttagtttccattaagcccaataacttgtatcgtttgcttagatacttagttcacatgaacctcttaaccattcatgttgttgaaggaaacgagacattttctttaacagaattgtccaagttacttcttagagatcagaagagaagtttagtaggttgggcactggcaatcatcgatgagacggttatcgatggttggcatgagttaagcgattgttgtacttcgccggctggtgctccgacaccttttgaaagagttcatgggaagagtgtatgggagttagctggggagaatgcagggatgaaccaagttattaatgatgctatggtgtctgatacaatattggtcatgccagtatttgttcaatgctgtgataaactcttgaatggaattacatctatcgtcgacattggtggtggtgttggcatggccatgagctatattgtcaaagcttttcctcatattaagtgtactgtcttcgatctaccccatgtcattgctgcctctgcgcagttgccaggagtggaaatggtcggaggtgatatgttcaaatgcattcccccagcggatgccatttttctgaagtttatgctccataattggcaagataaagaatgcatcaagattcttaagaaatgtaaagaagcaattcctcaggaaaaagggaaggtgatcatactggacatcgtgaccgataaagatgaggaggatgacgatttaacaagagcaaagatgaacctcgatattgacatgatggtaatttcaggagggagggagagaaccaagaatgaatggcaagttctcctgaaccttgctggttttagcaggcatgaaataattcccatcatggctgtacaatcagtaattgtagcatacccttga

SEQ ID NO: 781 - DNA, 1089 bp, Xanthoriza simplicissima
atgggttcaactcaaaactcaatcaaccttactccacaagaagaagaagaagcttgcttacatgccatgcaattagctagtgcatctgtcttacctatggtattaagagcagctatagagcttgatgtattagaggtcattgctaaagctggtcaaggtgcatgtatcacaccttctgaaattgcttctaaactatctactactaatacacatgcttctgttatgcttgatcgtattctgcgattgcttgctagttataaggtgctaagttgcaatttgcgcactttagaggatggtggtgttgagagatcatatggacttgcaccagtttgtaaattcttaaccaagaatgaagatggtgtctctatggctcctttggttctcatgaatcaggataaggtcctcatggaaagctggtacyatttgaaagacgctgttcttgatgggggaattccatttaacaaagcatatggaatgacagcatttgattatcatggcacagatcctagattcaacaaagttttcaatagaggaatgtcagatcactcaactataaccatgaaaaaaattcttgaaatgtataagggctttgatggtttgaaaactctggttgatgttggtggtggaactggtgctacaattaacatgattgttaaaaaacacccttcaattaaaggcattaactttgacttgcagcatgtcattgaagatgcaccaacttatccaggtatagagcacattggaggagacatgtttgttagcgttccaaaaggggatgccattatcatgaagtggattcttcatgattggagtgatgagcattctttgaagtttttgaagaactgctacgaatcattgccggcgaatggaaaggtgataatcgtcgaatcaattcttccagaattccccgagactaatcttgctgctaacggagcattccaactggataacattatgttggctcataaccctggaggcaaagagagaactgaaaaagacttcgagtctttgtcaggtggagctggttttgctgattttaaagtcgtatgttgtgcttttaatagttgggttatggaattctgtaaatag

SEQ ID NO: 782 - DNA, 1023 bp, Xanthoriza simplicissima
atgcaactaacaggagcagcagctttgccaatggtcatgagagtggcaatcgatctcgatgtatttgagatcatagctaaagcaggtccaggggtacagttgtcatcaaagagtattgcatcttatttacctactcaaaatccagatgctcacaagatgatcgaccgaatcctacgccttcttgccagctattctgtattaaagtcttctcttgtcaccggcgacgatggtttagctgaaagattatatggtttggaaccggtttgcaagtatttcgttagagatgaagatggtgtttcagtttctccatttatgcttttagttcaggacaaagttttcatagacagttggttccacttgaaagatgcagttcttgaaggtgggattccattcaacaaagcccatggaatgcatgcatttgagtacccagggattgaccccaaatttaataaagtctttaatagagcaatgttcagccacactacaatagtagtgaaaaagatacttgaagtatacagaggatttgaagacctgaaagaagttgtcgatgttggtggtggtcttggaaccacacttggtataatcacttcgaaatatcctgccattaagggtattaatttcgacttgccgcatgttgttgaacatgcaccatcttatccaggtgtagaacatgtcggaggaagtatgtttgacagtgttcccagtggtgaaaccattttcatgaagtggatacttcatgactggagcgacgaagaatgcataaaattgctgaagaattgttacaaagcactgccagaacatgggaagttgatcgttgtggatgcaattttacctgttgcacctgagtctgattccgctgcaaaaagcctatgtcaattagatgttagcatgatgacacaaaatccaggaggaaaagaacgcacggaggaggagtttgaaattctggccaagggagctggctttacaaccatcaataaggcatgttgtgtctataattattgggtaatggagttccacaaatga

SEQ ID NO: 783 - DNA, 1056 bp, Xanthoriza simplicissima
atggctgcaaaagatggtgtaaattatttatcaggtttaggcttatctcgcctaatatgtcttcctatggcactaagagcagcaattgagttaaatgtttttgaaatcatctcccaagctggtccagatgcttatctatcaccatcagatatcgttgcaaaaatccccacaaaaaatcccagtgctgcgatttccttggatcgaattcttcgaatgcttggtgcaagttcaatcctctctgtttccacaacaaaaagtggaagagtctatggattgaacgaggaatcacgttgtttggtggctcccgatgacaaagtttctgtggtacctatgttgctatttacttctgataaggctgttgtggagagtttctacaacatcaaagatgtcgtacttgaagaaggagttataccatttgatagaactcatggaatggatttctttcagtatgctggtaaagaacaaagagtgaacaaatcatttaatcaagctatgggagctggttccacgattgcttttgatgaagtgtttaaggtttacaaaggctttgataatttgaaagagttggttgatgttggtggtggtattgggacttcacttagtaacattgttgccaagtatccacatatccgtggtattaattttgagttgcctcatgttattggtgatgcaccagattacccaggcgtggaacacgttcccggagatatgtttgagggagtcccaaatgcacagaacattttgctcaagtgggtgcttcacgactgggatgacgatagaagcataaagatactaaagaattgctggaaagcattacctgagaatggaacggtaatcgtaatcgagtttgttcttcctcaagtattaggcaacaatgcagaatctttcaatgcattgactcccgatctcctgatgatggcattgaatcctggtggcaaagagaggacaacaatcgaattcgatggcctagctaagacagcaggatttgctgaaacaaaattcttcccaatttcacaagggcttcatgtgatggaattccacaaagttaaatgctag

SEQ ID NO: 784 - DNA, 909 bp, Argemone mexicana
atggcagaaataatgtcttatcctgaaacaaagaggtgtgcagttgttacaggtgccaataaggggattggatttgagatttgtagacaattagcttctaatggaatcatggttgtgttaacatcaagagataaagataagggttttgaagctgttgaaaaactcaaaagttctggactctctgatgtgatttttcatcaacttgatgtgatgaacccaactagtatttcttctttagcagatttcattaaaacccattttggaaaacttgatatcttggtgaataatgcagggattggtggggtcatagtagacgctgatcgttttaaggccctgaatctcggggctggtgagctcaacgacaaccctaaattgaaagaagtaatgacagaaacctttgaatcgacagaagaatgtttaaaaacaaattactatggtgttaaagcagtgacagaagcccttattcctttccttcaactatccaattcaccaataattgttaacgtatcgtcctcaatgggaatgctgaagaacatttctaatggaaaggctttggaagtactatgtgatgttgatgggttaacaaaagagagaatagatgaggtattgaatatgtttcttaaagattttaaggaaggtttattagaaacaaaaggatgggcagcaagattgtctgcatatataattacaaaagcatgtgtaaatgcttacacaaggattttagcaaaggaatttcccacttttcgcataaattgtgtctgccccggttatgtaaaaaccgatattaacttcaatactggagtgttgagtgttgaagaaggtgctaaaagtcctgtagatttggctcttctaccacataatggaccttctggcctcttctttgttcgctcagaaatatcgtcgttttga

SEQ ID NO: 785 - DNA, 927 bp, Argemone mexicana
atggcaacctcagtaaacagttcaacaacaaagaggtatgcagttgtgacaggggcaaataaagggcttggactaggaatatgcaagcaactagctgctgatcatagtgttaatatagtgttaactgctagaaatgaacaaaggggtcttgaagctgtcgaaaaactcaaagaatctgcgggtttaagtgatgatcaaatcaattttcatcagcttgatgttgctgaccctgcaagtgtttcttctcttgctgatttcgtaaaaaccaaattcggaagacttgatatcttggtaaataatgcaggaattgggggagttgctgtatacgaaaatggatttttagaccaagtgtccaagattaagaataatgggacaggagaagtcaaatgggatgagattttaactgagtcatacgagttaactgaacaatgcgtgcaaacaaactactatggggcaaaaagaatgacagaagcgctaattccattactgcagttatctgattcaccgcgtattgcaaatgtttcttcctccatgggaaaattaaagaatttaccaaatgaatgggctaaaggaatactaaatgatgagcaaaaccttacagaagtgagagtcgatgaggtgctaaatgagtacctgaaagattacaaggagggttcaatacaggaaaaaggttggccacgcttcatgtcagcatatgtaatctcgaaagcagcaatgaatgcatacacaaggatcttggccaaaaaatacccaactttctgcatcaatgccgcttgtcctggctatgtgaaaacagatataaatatgaatactggtaaattaagcgtcgaagaaggtgctaaaagtgtggtgaagctggcattgctgcctaatggtggaccatctggccttttcttctttgagggtaacatatcatcctttgagtaa

SEQ ID NO: 786 - DNA, 906 bp, Berberis thunbergii
atggcagaagcaaactccactaggccaacaaagagggttgcagttgttacagggtctaataaggggattgggtatgagatatgtagacagttggcttgtcatggaggagttgttgtagtcttaacagccagagatacaaaaaggggtcttgaagctgttgaaaagctcaaagaatctgggctttctgatgtgttttttcatcaactggatgtgatggactcaactagtattgcttctttggctgctttcatcaaaacccaatttgggaaacttgatatcttggtgaataatgcaggaataggtggggctacattggattcagatgctctcaaggccatgagacttgagggaaaaaatgcgaaacccaattggaaggagataatgacagagacctatgagggagcagttgaatgtctaaaaacaaattattatggtgtcaaacaagtcactgaagcactcattcctctccttcagttatccaattcaccacgtattgttaacgtttcatcctccatgggactgctcaagaatatctcccatgatgaggctaagggggtgcttagtgatgctgattgtctcacagaagagagagtggacaacatgttgaatgactttctaacggacttcaaggaaggtttactagaatccaaaggctggcctatatttctttctgcctatacaatctccaaggcctctttgaatgcctacacaagaatactagcgaagaagttaccgacttttcggataaattgtgtatgtccgggatatgtcaaaactgatatgaatgcgaatactggatccttgacagttgaagaaggtgcattaggtcctgtgacattggcgttcataccagatgatggaccctcaggtgtcttcttcagtggaacaaaagaagcaaccttttga

SEQ ID NO: 787 - DNA, 915 bp, Chelidonium majus
atggcagcagagataaggtctgatccagaaacaagaaagaggtgtgcagtagttacaggagccaataaggggattggatttgagatttgtcgacagttagcttcaaatgatgtcttggtggtattaacatctagagatactaagaggggaactgatgctgttcaaagtctcaaagattctggagtctctggtgtggtttatcatcaacttgatgttacggacccaactactgttgcttccttggcagatttcattaaaacccaatttggaaagcttgatatcttggtgaataatgcggggattggtgggatcgaagtagactatgatggtttaatcgccctaacacgtggggatggtgagctcgaagacaaccccaaatttaaagaagtaatgacacagacctttgagttggcagaagaatgtctaaaaacaaattactatggtgttaaagcagtaactgaatcccttattcccttccttcaactatccgattcagcaagagttgttaatgtttcctcttccatggggcagatgaagaacatctccaacgaaaaggctatagaaatacttagtgatgttgctgggttaacagaagagagaatagaggagttgatgaatgagtatcttaaggactttaaagaggatttgatagaaaccaaaggatggcctacaaagttatctgcatatgcaatctcaaaagcagctttgaatgcctacacaaggattttagcaaagaaatttcctacatatcgcataaactgtgtctgtcctggctttgtcaaaaccgatattaactacaatactggagtcttgactgttgaagaaggtgctgcaagtcctgtaagattggctcttttaccagatgacgggccttctggcctcttcttcttccgtgcagaagtatcggacttttga

SEQ ID NO: 788 - DNA, 912 bp, Chelidonium majus
atggcagcagagataaggtctgatccagaaacaagaaagaggtgtgcagtagttacaggagccaataaggggattggatttgagatttgtcgacagttagcttcaaatgatgtcttggtggtattaacatctagagatactaaaaggggaactgatgctgttcaaagtctcaaagattctggagtctctggtgtggtttatcatcaacttgatgttacggacccaactactgttgcttccttggcagatttcattaaaacccaatttggaaagcttgatatcttggtgaataatgcgggaattgttggggtcaaaatagactatgagggtttaacgaatctgatcaaggctggtgagtacaataacaacgacaaattgaagaaattaatgacacagacctttgagttggctgaagaatgtctacaaacaaattactacggagttaaatcagtgactgaagcccttattcccttccttcaactatctgattcagcaagagttgttaatgtttcctcctccacggggaagttgaagaacgtctccaatgaaaacgctaaaaaagtacttagcgatgttgatgacttgacagaagagagaatagatgaggttctgaatgtgttccgaaaggattttaaggaggatatgttagaaaccaatggatggcctgaaagattagcagcatatacactcgccaaagcagctttgaatgcctacacaagggttgtagcaaagaaatttcctacatttcgcataaatagtgtctgtcctggtgttgtcaaaacagaaattaacaactatactggagtcttgcctgttgaagaaggtgctaaagctcctgtaaggttggcccttttaccagatgatggacctaccggcgtcttctttttccgtgaagaagtaacagacttttga

SEQ ID NO: 789 - DNA, 939 bp, Chelidonium majus
atggctaaaacatgtccaaatactgttgttacaaagaggaggtgtgcagttgttactggcggaaacaagggtattggatttgagatttgtaagcaattatcttctaatggaatcatggttgttttaacttgtagagatgtaactaaaggtcttgaagctgttgaaaaactcaaaaattctaatcatgagaatgtggtttttcatcaacttgatgttacggatccagttactactatgtcttctttagcggatttcattaaaacacacttcggaaagcttgatatcttggtaaacaatgctggggttgcaggtttttcagttgatgctgatcgtttcaaggcaatgataagtgacattggagaggattcagaggagctcgtgaagatctacgaaaaaccagaagcccaagaattaatgacagagacatatgaattagcagaagaatgtctcacaataaattactacggtgttaaatcggtaaccgaagttctaattcctttacttcaactatctgattcaccaagaattgttaatgtttcatcatccacgggaagcctcaagtatgtatccaatgaaacagctctagagatacttggagatggtgatgcattaacggaagagagaattgacatggtagtgaatatgcttcttaaggattttaaggaaaatttgatcgaaacaaatgggtggcctagtttcggagctgcatacacaacatcaaaagcatgtttgaatgcttacacaagggtgttcgcaaagaaaattcccaaatttcaggtcaattgtgtttgtcctggtttggttaaaacagaaatgaactacggcattggaaattatactgccgaagaaggtgctgaacatgtagtcagaatagctcttttccccgacgatggaccttctggttttttctatgattgttcagaactatctgcattttga

SEQ ID NO: 790 - DNA, 906 bp, Cissampelos mucronata
atggcggaaactggtgcaacaaagaggtgcgcagttgtgacgggagggaacaaagggcttggattggaggtgtgccgtcagttggcctcgaacggcgtgtttgtggtgttgacggccagagatgagaagaaaggcagcgaggctgttgagagcctcaaagcctctggggtgtcggatgtggtctttcatcagctcgatgtggctgaccctgccagtgttgattccttggctcatttcatcaaaaatcgttttgccaaacttgatatcttggtgaacaatgccggaatcagtggttccgttccaactgttgatgatgccttcgaaaaagagaagcttccagaagagcccggacaaaggatggtatacatgatgcagtcaataacaggaacttacgaatctagtaaagaatgtctggttacaaactactacggtacgaaaagagttaccgaggcgcttcttccattgcttcagctctcaaattctgcgacgattgtcaatgtttcatcttctgcaggactgctgcagggaattggtcacaagagagctatagaattgctcgacgatattgatgaaaacaccgataaaaaagtggaggaggtattgaatgagttcctcgaagattacaaggaggggtccccagaagccaaaggatggcctagtaggtcactgggtgcttacatgctgtctaaagcagcgatgaatgcctacacaagatttctagccaagaagtttccatcgttccgcatcaactgcgtgtgccctggttatgtgaagacagacatgaatttcaacactgggctcttgactgttgaagaaggtgccgaaaagatagtgaagctagcctcgcttccagatgatggccctactggtctcttctttagaaatgatgaagtacatgctttttga

SEQ ID NO: 791 - DNA, 915 bp, Cissampelos mucronata
atggaggagactactccaactctagcagaaaagaggtatgcagttgttactgggggcaacaaaggaattggattcgagatatgtcgtcaactagcatcgaaagggatcgtggtcatattaacagctagatatgaaaagaggggtattgaagctgttgagaagctggagtcacttggagtttctaatgtggttttccaccaactagataccatggatcctactagtattgctttgttggctaattttgtcgaaaccaattttcgcaaacttgacatcttggtgaacaatgcgggatgcaacggacttgtgatgtattccgaagcatatacagcctttatcgatgctggaaatcatgtaacagatgataaggtaggctcattgaagggaattgtagagcagacatatgagaaggcagaagaatgcatcgaaacaaactacttcggaaccaaacgagtaacagaagctcttcttccgctccttcaactctctgattcgccaagaatcgtaaatatatcctccatttacagtcagctaaagtttattgctaatgagaagatcagagcggagctgaacaatgtggagtgccttaaagacgagaggttggatgaggtggtccaacaatttctgaaggattttaaggaggaccagttactacagaatggatggcctctcactctgtcggcgtacaaagtctcgaaagctgccattaacgcatacactagaattctagcgagaaaattccccaagtttcgcataaacagcaaccatcctggttatgtaataacagatattacatgtaatagagggttactgacccctgaagaaggcgcgaaacgccctgtaatgcttgctctgttgcctgataatggtccatctggtctctactttgatcaaatggaagtatcaagcttttga

SEQ ID NO: 792 - DNA, 915 bp, Cocculus trilobus
atggccgaaacaccagtcagcagtgctgcaaccaagaggtgcgcagttgttacaggagggaacaaagggattggactggagttgtgccgccagttggcttcaaatggagtgttggtggtgttgacagccagagatgagaagaggggcactgaagctgttgaaaaactcaaagggtctgggctctctgatgtgttttttcatcagctcgatgtgaccaaccctgcgagtgttgcttctttggcagatttcatcaaaacccattttggaaaacttgatatcttggtgaacaatgctggaatcagtggcgctactgcagattttgatgcattaaacaaagaaaaccttccagaagaggctggaccaaggcttttcgctatgatgcaagctctatcagagaatttcgaaatgactaaagaatgtctggaaacaaactaccatggcacaaaacgggttactgaagcacttcttccattgcttcagctctcaaattcagcaaggattgtcaatgtttcatctagtgcaggtctgctacagggcataagtcatgaaagagctaaagaagtgttcagtaatattgacgaactcacagaaaagaatgtggacgagttgttgaatgagtacctaaaagattacaaggagggttcaccagaaaccaaaggatggcctgctagatcattagctgcttacatgttgtctaaagcggccatgaatgcctacaccagatttctagctaacaagttcccttcgttccgcatcaacagcgtatgtcccggttatgtcaaaacagatataaattttaatactgggctcttgagtgttgaagaaggcgcagatagcttgctgaggctagctttgcttcccaatgatggtccgtctggcctcttcttcagaaataaggaagtatcaatattttga

SEQ ID NO: 793 - DNA, 882 bp, Eschscholzia californica
atggcagacactaggagaaggtatgcaattgttacaggtgccaataaaggaattggattagagatttgtaaacaattagcttctaatggaatttttgtagttttaacatctagagatgaaaacagaggaattgaagctgtcggaaaactcaaaaactctggtatttctgatgttgtttttcatcaacttgatgtgatgaatccatcaagtatttcttccttggctgatttcatcaaaacccaatttgggaagcttgatatcttggtgaacaatgcggggattagtggagttactgtagatgctgatggtttaaagaaaatggaagaatatgatgcgcgaaaagagaacccgggctttgaagaaattatgatagagacctatgagatggcagaggaatgtctgaagacaaattattatggtgttaaagctatcactaaagctcttattccttttcttgaacaatccaattcagcgagaattgtgaatgtttcttccacgtctgggaaactcaagaacatcccagatgaaaaggtgaaggagatatttagtaatattgatgagttaacagaagagagaatagatgaggttctaaatctatttctcaaggatttcaaggagggtttgttaaaaacaaaaggatggcctacttggtcagcttataccatctctaaagcagctctaaatgcatatacaagaattttagcaagaaaacttccgtcttttcgggtgaattgtgtgtgtccaggttatgtcaaaacagatattacttacggtactggactcttgactgttgaagaaggtgctaaagatcctgtaatggcggctcttttaccggacgatggaccttctggcgtcttttttttccgaggcaaaggtttctga

SEQ ID NO: 794 - DNA, 900 bp, Eschscholzia californica
atggcaatggaaactgctgaaacaaagaaaagatttgcagttgttacaggtgctaataaaggaattggatttgaaatttgtagacaattagcttctaatggagtatttgtagtattaacatctagagatagaaacagaggaatggaagctgttgaaaaactcaaaaactctggactctctgatgttgtttttcatcaacttgatgtgatgaatccaacaactatatcttctttggctgatttcattactacccaatttgggaagcttgatattttggtgaacaatgcgggtgttggtggaattatagtagacgttgaggcatttaaagggatgagagaagggcacgatgagcacaaagataagagtctcaaagatgtaatgaccgagacgtatgaggtagtagaagagtgtctaaaaacaaattactatggtgctaaagcagtgacagaagctcttattcctttgcttgaactctccaattcagcaagaattgttaatgtttcatccagtatgggacaacttaagaatatccacaacaaagaggctaaggagatacttggtgatgccgaagggttaacagaagagaaaatcgatgaagtcctgaatacgtttttgaaggattttaaaaaagattcgttagaaagcaaagaatggcctgtattttcaggatatacattctctaaagcagctctgaatggatatacaaggatcctagccaagaaatttccaacttttctggtgaattcggtttgtcctggttatgttagtacagatattaacttcaatactggaatcttgactgttgaagaaggtgcaaaaagtccagtaaggttggctcttttaccagatgatggaccttctggcctcttctttatcagagctgaagtttctgaagtttga

SEQ ID NO: 795 - DNA, 909 bp, Glaucium flavum
atggcagaaataagatctggttctgaaagaaagaggtgtgcagttgttacaggtgccaataagggatgtggattggagatttgtcgacaattagcttctaatggagtcttggttgtattaacatctagagacatcaaaaggggtactgaagctgttgaaaatctcaaaaattctggactcccacttgtagtctttcatcaacttgacgttacgaacccaaccagcattgcttcattggcagatttcatcaaaacacaatttggaaagcttgatatcctggtgaacaacgctgggataattgggggaattgcagatgctgaaggtttcagggcaatggcagaagcgtatggcaagccccatcacaaacaagttatgacagaagtaatggcagagaccaatgagttgtcagaagaatgtctcaaaacaaattattatggtgcaaaagcagtgactgaagctcttcttcccttccttcaaatatccgattcagcgagaattgttaatattgcctccatcacggggaagttggagaacatctccaatgaaatggctaagaaggtacttagtgatattgatggcttaacagaagagaaaatagatgaggtgctgaatgcatatgttaaggatttaaaggataatttgttggaaactaaaggatggcctgcgaacggatgcgcatatcgactctccaaagcagctttgaatgcctatacaagaattttggcaaagaaatttcctacatttcacgtaaatagtttctgtcctggtcatgtgaaatcagacattaattgcaatactggagtcttgactgctgaagaaggtgttaggaagcctgtaagcttgactcttttacaagatgacggaccttccggcctcttctttgtccacggagaagtatcagacttttga

SEQ ID NO: 796 - DNA, 909 bp, Glaucium flavum
atggcagagataaggtcagatgctgaaagaaagaggtgtgcagttgttacaggtgccaataaggggattggatttgaaatttgtcgacagttagcttctaatggtttcttggtgatattaacatctagagatactaagagggggactgatgctgttgaaaaactcaaagattctggaatcactgatgtggtttttcatcaacttgatgttatggacccaactagtattgcatccttggcagagttcatcaagacccaatttggaaagcttgatatcctggtgaataatgcggggattggtggggttgaagtacaacatgatgagttaagggccctgaaacaagcccatggtgaggtcaaggatttctccaaattgggagaaataatgacaaacgtcaatgagttgacagaagaatgtctaaaaacaaattactatggtgttaaaacactgactgatgcccttattccattccttcaactatctgattcagcaagaatagttaatgtttcctcctccttggggaacctaaagaatatcccaaatgagaaggctaaggatgtacttagtgatgttgatggcttaacggaacagagaataaatgagttgctgaatgagttcttcaaggattttaaagaggatttattagaaaccaaaggatggcctgtaaggatatctgcatacatactctcaaaagcagctttgaatgcctacacgaggattttagcaaggaaatttcctacgttccgcataaactgtgtctgtcctggttatgtcaaaacggatataacctacaatactggagccttcactgctgaagaaggtgctgaaagtccagtaagattggctcttttaccagatgacggacctactggcctcttcttctaccgtgcagaagtcgcggacttttga

SEQ ID NO: 797 - DNA, 918 bp, Hydrastis canadensis
atggaagaaatagtaccttcaaatccatcatcaaaaaggtatgcagttgtgactggaggaaataaaggaattggattagagatatgtcgtcaactagcatctaatgaaatcttggtcatattaactgcaagagatgagaaaaggggcaatgaagctgttgaaaatcttaaaagatcaggactctctgatgtgattttccatcaacttgatgtcaaagatccttcaagtattgcttcattggcaaatttcattaagacccatttcagaaaacttgatatcttggtgaataatgcagcggatgggggagttataatagatggtgaggctttcagaggcttaaggtccggttttgatacagtaagtgatgaaaggcccgaattgctgaagggaataatggagcaaactaatgagaaggcagaagaatgtttgaaaaccaattattatggaaccaaaggagtaactgaagcacttctccctttccttcaactctctgattcagcaagaatagtgaatgttacttccgtttatgggcaactcacgtttatctcaaatgagaaggttaaatcagagctgaacaatgtggagtgcctaagagaagagcgcttagacgagatattgcaatggtttctaaaggatttcaaggaagataaagtgcaagttaatggctggcctataacggtatctgcttacaaagtctccaaagctgctgtaaatgcctacacaaggatcttagcgcgaaaattccccaacatgcgtataaattgcgtccatcctggttatgtgaaaacagatattacatgtaacacaggatttttaaccgctgaagaaggcgctagacctctggtaaaactggccttgttacctgataacggcccttctggccactactttaatcggatggacatgtcgacattctga

SEQ ID NO: 798 - DNA, 909 bp, Hydrastis canadensis
atggaagaaatagtaccttcaaatccatcatcaaaaaggtatgcagttgtgactggaggaaataaaggaattggattagagacatgtcgtcaattagcatctaatgaaatctttgtaatattaactgcaagagatgagaaaaggggtattgaagctgttgaaaatcttaaaagatcaggtctctctgatgtgatcttccatcaacttgatgtcaaagatccttcaagtattgcttcattagcaaatttcattaagacccatttcagaaaacttgatatcttggtgaataatgcagctgatataggagttataatagatggtgaggcttggtccggttttggtgatgtaagtggtgatgaaagacgcgagttgctgaggggaataatgaaggaaactaatgagaaggcagaagaatgttttaaaaccaattattatgggaccaaaggagtaactgaagcacttctccctatccttcaactctctgattcagcaagaatagttaatgtttcttccatttatgggctacttaagattatcccaaatgagaaggttaaatcagagctgaataatgtcgactgcctaacagaagagcgcttggatgagatattgcaagggtttctaaaggatttcaaggaaaataaattggaagcgaatggctggcctataactgtatctgcttacaaagtctccaaagctgctgtaaatgcctacacaaggatcttagcgcgaaaattccccaacatgcgtataaattgcgtccatcctggttatgtgaaaacagatattacatgtaacacaggatttttaaccgctgaagaaggcgctagacctctggtaaaactggccttgttacctgataacggcccttctggccactactttaatcggatggacatgtcgacattctga

SEQ ID NO: 799 - DNA, 858 bp, Jeffersonia diphylla
atgtatgcagttgtgactggggctaataaaggtattgggtttgagatatgtagacagttagcttccaatggcgtcgtggtggttttaacggctagagatgagaagaggggtgctgaagctgttgaaaatcttaaagaatctggactgtctaatgttgtttttcatcaacttgatttgatgaatccaactggtctttcttccttagcagattttattaaagctaaatatgggaaacttgatatcttggtgaacaatgcagcaatcagtggaagcataataaacactgatgctttaagggttgatagccaggggcaaagcaacttaatggacacattaatacaaacttacgagttatccgaggaatgcctgaaaacgaactactacggtaccaaagcagtgactgaagcacttcttcccttgctccaactttccagttcacctaggatcgttaatgtttcttcccggttaggccaattagagaatattcccaatacatgggctaaaggggtactatctgatgttgatattctcaccgaagagaagatagatgaagtccttaatgagtttctgaaggaccttagggagggctctttagaaaccaaaaactggtcaactgctttttctgcctatcgactctccaaagcagcactgaatgcctacacaaggattttagcaaagaagctccctaaaatcaacatgtattgtgtatgtcctggctatgtaaaaacggatatgaactcccacactgggatcttgactgttgaagaaggcgctgaagggccggtgaagttggccttgaaccctaatggtggctcttcaggactcttctttgctcaccatgaagtagtatccttttga

SEQ ID NO: 800 - DNA, 912 bp, Menispermum canadense
atggcggaaacagtgataactagtcctgcaaccaagaggtgtgcagttgttacaggaggtaataaggggattggattggagttgtgccgtcagttggcttctaatggagtgttggtggtgttaacagccagagatgagaaaaaggggattgaagctgttgagaatctgaaaggttgtgggcttcctgatgtggtttttcatcagcttgatgtgacggactctgctagcgtagcttccttggcagatttcatcaagacccattttggaaagcttgatatcttggtgaacaatgcaggtattggtggtttcagtgtagataatgatgcattgaagacaacaaagctttcagatgcggtggaagagagggcgcagagtttttttagagctataagagagacttatgaattggcgaaagaatgtttggaaacaaactactatggcacaaaaagagtcactgaagcacttgttccgttgcttcagctctcaaattcagccaccattgttaatgtttcatccagcgctggactactaaagaacatctccaatgaaagagctaaagaattgctaagcaatattgatgaactcaccgaagagaaagtggacgagctgctaaacgaattcctaaaagattacaaggatggtttatcagagtccaaaggatggcctgtaacaggatccgcttacaaaatgtctaaagcagcgatgaacacctacacaaggtttctagctagcaagttcccttccttccgcatcaacagcgtttgtcctagttatgtgaaaacagacattaatttcaacactgggatcttgactgttgaagaaggtgcagggagcatactgaggctagctttgcttccaagtgatggtcctactggcctcttctttagcaaaatggaagtatctccattttga

SEQ ID NO: 801 - DNA, 912 bp, Menispermum canadense
atggccgaaacaatctccagcgttgcagcaactatgaagtgcgccgttgttacaggagccaacaaagggattgggtttgagatatgccgtcaattagcttctaatggagtgttagtggttttaacagccagagatcaaaataagggtttagaagctgtggagaaactaagagcgtctgggctctctgatttggtgtttcatcaactcgacgtgatggactcggctagcattgcggccttggcagatttcatcaaaacccatttcgggaaacttgatattttggtgaacaatgcaggaattggtggggtcatagtggactgggatgctttgattgccctgaaagcagaagttgagcaaaaaggtgagcaactgaatttgagagaagtaacaacagatggctatgaattagcagaagagtgtttgagaacaaactactacggagtcaaagaattgactgaagcacttattcccatgcttcagctctccagctcaccaagggtggttaatgtttcatcctcttatgggcaactaaagattgtctctaatgaaagagctaaagagatactaagtgaggttgattaccttacggaggagagagtggatgaggtgttgaatgggtttttaaaagatttcaaagaaggtctgctggaaaccaaaggctggcctactgttctctctgcttactcagtttcaaaagctgctctcaatgcctacacaaggattctggctaggaaacacccaactttctacataaactgtgtctgccctggccatgttaaaacggagacgaatcgtaattcagggatgttgagtactgaagaaggcgcggagagtctggtgatgctagctttgctgcctgatggtgggccttctgggcgcttctttaatcggaaggagttatcatcgttttga

SEQ ID NO: 802 - DNA, 770 bp, Nandina domestica
atggcagaaacaaacaataagaatcctgcaacaaagaggtatgcagttgttacagggtctaataaggggattgggttagagatatgtaggcagttagcttgtcatggagtttttgtagtgtcaacagctagagatccaaagagaggcattgaagctgttgagaagctcaaagaatctggagtttctgatgtagtttttcatcaacttgatgtcactgatccaattagtattgcttccttggctagtttcatcaaagcccaatttgggaaacttgatatcttggtgaacaatgctggaattatgagtgcggctatagtagattgggatgctttggctgcaacccttggcgagtctaaagacgagaaacccaactataaggagatgatggaacagacttacgagttggcagaagaatgtctgaaaataaattactatggagttaaacaagttactgaagcacttattcccttgctcgagttatctgattctccacgaattgttaacgtttcatcatcacttggactgctcaagaacatccccaatgaagaggttaagaaggtgcttagcgatgcagacagtctcacagaagaaaaagtggacactttgttgcatgcatttctaaatgatttcaaggaagatttgctagaaccaaaaggctggcctgtaattctttcagcttatacagtctctaaagcagctctgaatgcctacacaagaattctagcaaagaaattccccacttttcgcgtaaattctgtttgtccaggtta

SEQ ID NO: 803 - DNA, 1039 bp, Nandina domestica
atggcagaaacagtctccaattctggaactaaaaggtgtgcagttgttacaggggctaataaaggtcttggattggagatatgtagacagttagcttcaaaaggtgtcttggtggtcttaacagctagagatgaaaagagaggtgttgaagctgttgaaaatctgagacagtgtggagtttctgatgtggtttttcatcaacttgatttggtgaacccaactagtattgcttccttggcagaattcattaaagatcaattcgggaagcttgatatcttggtgaacaatgcaggaatcagtggaagtgtaatcaacaatgatgcattaagggcacatgggcaagtcattatttcaagtatacatgtactggatgcaatggtagagtcttttgagtcggcggaagagtgtctgaaagcaaactactacggcacaaaacaagtgactgaagaacttcttcccttgcttcaactttccaattcagcaacgatcgttaatgtttcatcctcaataggccagttaaagaatatcaccaatgaatgggctaaagagatgctaagcgatgttgatggtcttactgaagagaaaatagatgaagtgttgaatgagtttgtgaaggactatagggagggattgctggagagcaaaagctgggcacctgctcttcctgcctatacactctctaaagcagctgtgaatgcttacacaaggattctagcaaagaagttccctacaatacgtataaattgtgtatgtcctggttttgtaaaaacagacttgaactccaatattgggacactgactgttgaagaaggcgcggaaggtccggtggggctggctttgatgcttgatgataggtcttctggccaattcttttctaagaaggaagtggtatccttttgacgttaaaacagacattaacggtaataccggaactttgaccgttgaagaaggtgcggaaagtgcagtgaggttggcatttttacctaacgacgggccttctggtgttttctttgatcgaaaagaagaatcgtccttttga

SEQ ID NO: 804 - DNA, 924 bp, Nandina domestica
atgcttctttcttggtttctcttattccgttcctcaccggcgtttctaatgccgacttatctgttcaggtgtgcagttgttactggggctaataaaggtattggattggagatatgtagacagttggcttcaaatggggtcttggtggtcttaacagctagagatgaaaagaggggtgttgaagctgttgaaaatctcagacagtgtggacttactgatgtggtttttcatcaacttgatttgttgaacccaactagtattgcgtccttggcagaattcattaaagctcagttcgggaagctcgatatcttggtgaacaatgcagcaattaatggaatcatgataaacactgatccgttaagggttcagagcgattggcaaaccattgtaagggaagcagtagtacagacttatgagttggctgaagaatgtctgaaagcaaactactatggcaccaaaggagtgactgaagcacttcttcctctgcttaaactttccaattcagcgaggatcgtcaatgtttcatcccgatatggtcagctaaagaatatctgcaataaatgggctgaagaggttctaagtgatgttgatagtctcactgaagggaaaatagatgaagtgttgaatgagtttctgaaggactacagggagggcttgttggagagtaaaagctggccagctgcaccttctgcttacatagtctcgaaatctgtcattaatgcatacacaaggatcctagcaaagaagttccctactataagtataaattgtgtatgtcctggttttgtaaaaacagacttgaactccaatattgggacactgactgttgaagaaggcgcggaaggtccggtggggctggctttgatgcttgatgataggtcttctggccaattcttttctaagaaggaagtggtatccttttga

SEQ ID NO: 805 - DNA, 990 bp, Nandina domestica
atggatcctagtgagctagacatgaaggacaagtttgggcttgcactcttgaaagwgktwyygcttttsatcactacactcttcttcctaacatcaatggcagggatttccacttcttcaaccaaaaggtgtgcagttgttacaggggctaacaaaggcattggattggagatatgtagacagttaccttcaaatggagtcttggtggtcttaacagctagagatgaaaaaaggggtgttgaagctgttgaaaatctcagacagtgtggactgtctgatgtggtttttcatcaacttgatttgatgaactcaactagtatygcttccttggcagaattcattcaaactcaatttgggaagcttgatatcttggtaaacaatgcagcaatccatggaactataatagacaatgatgctttaaaggctcagagccatgggaatgcttggagtgctttaacaggggctatggtacagacgtacgagttagcagaagaatgtattaacacaaactaccatggcaccaagggagtgaccgaagcacttcttcctctgcttcaactttccaattcagcaagaattgttaatgtttcatccaaaataggccaactagagaatatttccaatgaatgggctaaagagatgctaagtaatgttgacaatcttactgaagagaaaatagacgacgtgctgaatgagtttctaaaggactataaggagggactgttggagataaaaggctggccaattgctccttctgcctatagaatctccaaagctgctgtgaatgcctacacaaggattttagcaaaaaagttccctatgatcagtataaattgttgcactcctggttttgtgaaaacagatatgagtgctcatattgggagattaagtgttgaagatggagcaaaagctgtggtgatgatagctttgttgcctgatggtgggccttctggccttttctttgttcagaaagaagtagcttccttctga

SEQ ID NO: 806 - DNA, 936 bp, Papaver bracteatum
atggctgaaacatgtccaaatactgttacaaagatgaggtgtgcagttgttactggcggaaacaagggtattggatttgagatttgtaagcaattatcttctagtggaatcatggttgttttaacttgtagagatgcaactaaaggtctggaagctgttgaaaaactcaaaaatactaatcatgagaacgtggtttttcatcaacttgatgttacggatccaattactactatgtcttctttagaggatttcatcaaagcacgcttcggaaagcttgatatcttggtaaacaatgctggggttgcaggtttttcagttgatgctgatcgttttaaggcaatgataagtgacattggagaggattcagaggagatcgagaagatctacgaaaaaccagaagcccaagaattaatgtcagagacatatgaattagcagaagaatgtctcaaaataaattactacggtgttaaatcggtaaccgaagttctacttcctttacttcaactatctgattcaccaagaattgttaatgtttcatcatccacgggaagcctcaagtatgcatccaatgaaacagctctagagatacttggagatggtgacgcattaacagaagagagaattgacatggtagtgagtatgcttcttaaggattttaaggaaaatttgatcgaagcaaatcggtggcctagtttcggagttgcatacacaacatcaaaagcatgtttgaatgcttacacaagggtgttagcaaagaaaattcccaaatttcaggtgaattgtgtttgtcctggtttggttaaaacagaaatgaactacggcattggaaattatactgccgacgaaggtgctaaacatgtagtcagaatagctcttttccccgacgatggaccttctggttttttctatgattgttctgaactatctgcattttga

SEQ ID NO: 807 - DNA, 918 bp, Papaver bracteatum
atggcttctaaaatgagatgcgcagttgttaccggtggaaacaagggtatcggatttgagatttgcaagcagttagcttcaaacggaatcacggttgtgttaacttccagagatataaagaaaggtcttgaagctgttgaaaaactcaaaatttgtaacaagaatgtggtttttcatcaacttgatgttgtgaatccaatcactatttcttctctagcagatttcattaaagcacacttcggaaagcttgatatcttggtaaataatgctggggtgagtggtgtttcaatagatgttgatcgttttagagaaatgactagtggtattggcgagggttcagaggagactgagaagctccttgaacagctagagaaaccagaaatgaaagaactactgactgaaacatatgaattagcagaagaatgtcttaaaacaaattactacggtgttaaatcggtgaccgaagttcttattcccttacttgaactatctgattccccaagaattgtcaatattacatccatcaacggaagcctcaagaatataactaatgaaaccgctcttgagatacttggagatgttgatgcattgacagaagagagaattgacatggtagtgaatatgtttcttaaggattttaaagaagatttaatcgaaacaaaagggtggcctagttatgtaactgcatacaaaatatcaaaaacatgtttgaatgcgtacacaaggattttagcaagaaaatatgctacgtttcgtgtaaattgtgtttgcccaggttttgttaaatcagattttaactgcaacattggaatttttaccgtcgaagaaggtgctaaacatgcagtaactatagctcttttaccggatggcggaccttcgggttttttctatgaacgagcacaactatctgcattttga

SEQ ID NO: 808 - DNA, 951 bp, Papaver bracteatum
atgctttcaaatagcgaaacaaagataaggtgcgcagtggttacwggaggaaataaggggattggatttgagatttgtaagcaattagctctaaatggaattttggtagtgttaacatctagagatataaagaaaggtcttgaagctgttgaaaatctcagaagctgcactgcaaaaaatgtggtttttcatcaacttgacgttttgaatcctcttactatttcttcgttagctgatttcattaaaacccgtttcagaaagcttgatatcctggtcaataatgctggggttactggtttttctattaatgatatagatcgatatgtagcgatgcaacaaagtataattggtgagaaacaaaaggaggagagctcttttgatggactcaaaggagagctagagaaacaagaaataaatgatttgtttatagaatcttttgaattagcagaacattgcctgaaaacgaattattatggtgttaaatcagtgactgaaattcttattcctctactacaactatccgattcaccaagaattgttaatctctcgtcaatgtatggaaacatcaagaatatatccaataaaaaagctatggaagtacttggagatgttgatctgttaacagaagagagaatagatgaggttgcgaacatgtttcttaaggattacaaggaagacgcgttggaaaccaatggatggcccggttcttcatctgcatataaaatatcgaaagcctgcttgaatgcgtacacaaggattttggcaaagaaattctctactttttgtgtcaattctgtttgccccggttgggtcgacacagacatgaactacaatattggaatttttactgcagaagaagccgctaaaaatgcaataactttagcacttttacaagataatggtcgaccttccggccaattctttgaccgtgaagtagctactgcattttga

SEQ ID NO: 809 - DNA, 939 bp, Papaver bracteatum
atgctgaatcaaaaaatcaggtgcgcagttgttactggtggaaataagggaattggatttgagatttgtagacagttagcttctaaggggattacagttgtgttaacggctagagatgtgactaaaggtttaaaagctgttgaaaagctcaacaattcatttggacttgctaatgttgtttttcatcaacttgatgtgatgaatccgattattatttcttctctttctgatttcattggaagtcaatttggaaaactagatatcctggtaaataatgctggagtttctggagttataactgatgttgctggttttactgcggtcgtacaagctcttattgagaaggaccagaacagagaaaatgcaaatttgaaacaaatgataaaaaatcggaaagcaaatctgaaacaaatgataaaagagacttatgaatcagcggaagaatgcctgcaaacaaattattatggtgtcaaatcagtgactaaagcacttattcctttacttcaactctctaattcaccgagaattgttaatgtatcctccctcgcagggcagctgaagaatgtctgtaatgaagaggctttggggatacttagtgatggggatggcttaaaagaagagagtgttgataagacggtgagtatgtttcttgaagatttcaaggatgatttattagatataaaagggtggccggcatatttacctgcgtatacactttcaaaagcaagtttgaatgcttatacaaggatattagcaagggaatttcctacttttcgcataaattgtttatgccctggttatgtcaattcagattttaactgcaacactggagttgtcactgttacagaaggtgcgaaaagagttgtagatttagctcttgtacctgatgatggaccttccgrcctctactttattgatggagaagtatcaccatattga

SEQ ID NO: 810 - DNA, 915 bp, Papaver bracteatum
atgtgtgcagttgttactggtggaaacaagggtattggatttgagatttgtaagcagttagcttctaatggaatcatggttgtgttaacttctagagatataaaaaaagggcttgaagctgttgaaaaactcaaaaggtccaacggaatttgtagccagaatgtgttttttggtcaacttgatgttgtgaatccagaaactatttcttctttagcagatttcattaaaacacaatttggaaaacttgatatcttggtaaataatgctggggtgagtggtgtttcgatagatgttgatcgttttaaagtattgacaagtggtattggcaaggattcagaggagactgagaagctccttgaacagctacaaacaccagaaataaaagaactactgacagaaacatatgaattagcagaagaatgtctcaacacaaactactacggggttaaatcggtgaccgaaattcttattcctttacttcaactatccgattccccaagaattgttaatatttcatccatcgttggtagcctcaagaatataacaaatgaaactgctcttgagatacttggagatgttgatgcattaacagaagagagaatcaacatggtagcgaaaatgtttcttaaggatttcaaacaaggtttaatcgaaacaaaagggtggcctaattatgtaactgcatacaaaatatctaaagcatgtttgaatgctcacacaagaatgttagcaaaaaaatttgctaagttttatgtcaattgcctttgtcccggtttggtcaagtcagattttaactacaacactggaatttttactgctgaagaaggtgctgaaaatgcagtaactctagctcttttaccagatgacggaccttcgggttttttctatgaacgttcagaactatctgctttttga

SEQ ID NO: 811 - DNA, 906 bp, Papaver bracteatum
atggattcagaaacaaaaaacaggtgtgcagttgttaccggtggaaataggggaattgggtttgagatttgtagacaattagcttctaatgggatttcagttgtgttgacggctagagatgtaactaagggattagaagctgttgaaaagctcaagaattcttttggactttctaatgttgtttttcatcaacttgatttgatgaatctagttactcttccttctttggttgatttcattggaagccattttgggaagcttgatattttggtgaataatgctggaattcttggagcgataacagatgctgctagttttaaagcactggtggaagctgttgagatggacaagaacgaagaaaaaccaaatttgaaacaagtgataacagagacgtatgaatcagcagttgaatgcatgcaaacaaattatcatggtgtcaaatcagtgactaaagcgcttatccctttactccaactctctgaatcgccaagaattgttaatgtctcttccgccttgggaaaattaaagtttatctctaatcaaatggctttggaaatacttaatgacggggatggcttaaaggaagaaagtgtagatgaaatagtgaatatgtttctaaaagattttaaggaggatattttagaaatacaaggatggcatgcatatttgcctgcatatactatctcaaaaatatgtctgaatgcttatacaaggatattagcaagggaatttcctacttttcgcataaattgtttatgccctggttatgtcaattcagattttaactgcaacactggagttgtcactgttacagaaggtgcgaaaagagttgtagatttagctcttgtacctgatgatggaccttccggcctctactttattgatggagaagtatcaccatattga

SEQ ID NO: 812 - DNA, 918 bp, Papaver bracteatum
atgaatatggcagaaacactcctgaatcctgaagtaaagaggtgtgctgtggttacaggtgccaataagggaataggatttgagatttgtaggcaattagcttctaatgggatctttgttgtattgacatctagagatagaaacaagggtcttgaagctgttgaaaatctcaaaaaatctggactctcaaatgttacttttcatcaattagatgtcatgaatctaacatccgtctcatccttggctgaattcattcaaacccattttggaaaacttgatatcttggtgaataatgcaggcattggtggggtgacaatagtagatgaggatcaactaagggttctgatgcttgaggatgaaaagtatttagagaacccaaagttgaaacagatatggacagaaccgtatgacgaggcagaaaaatgtcttcaaacaaattactacggcgtcaaggcggtgactgaagcctttattcctttacttgagctatctgattcaagaataattgtcaatgtttcttctgccatggggatgctgaagaatgttggcaatgaaaaggctttcgaagtgctcagcaatgctgattgtttaacagaagaaagaatagatgtggtggtgaatacatttttaaacgatcttaaagagggttgcttagaagcaaaaggttggccaacattactttctgcttatactatctcaaaagcatctgttaatgcgtacactaggattctggcaaaaaaatttcctacttttcgcataaactgtgtctgtcctggttttgtcaaaaccgatatgaactttaatagtggtgtcttgactgttgaagaaggtgctaaaagtcctgtaagattagctctcttaccagatagcggaacttctgggctcttctttgttcgtgaagaagtatcgtcattttga

SEQ ID NO: 813 - DNA, 918 bp, Stylophorum diphyllum
atggcttctaaaatgagatgcgcagttgttaccggtggaaacaagggtatcggatttgagatttgcaagcagttagcttcwaacggaatcacggttgtgttaacttccagagatataaagaaaggtcttgaagctgttgaaaaactcaaaatttgtaacaagaatgtggtttttcatcaacttgatgttgtgaatccaatcactatttcttctctagcagatttcattaaagcacacttcggaaagcttgatatcttggtaaataatgctggggtgagtggtgtttcaatagatgttgatcgttttagagaaatgactagtggtattggcgagggttcagaggagactgagaagctccttgaacagctagagaaaccagaaatgaaagaactactgactgaaacatatgaattagcagaagaatgtcttaaaacaaattactacggtgttaaatcggtgaccgaagttcttattcccttacttgaactatctgattccccaagaattgtcaatattacatccatcaacggaagcctcaagaatataactaatgaaaccgctcttgagatacttggagatgttgatgcattgacagaagagagaattgacatggtagtgaatatgtttcttaaggattttaaagaagatttaatcgaaacaaaagggtggcctagttatgtaactgcatacaaaatatcaaaaacatgtttgaatgcgtacacaaggattttagcaagaaaatatgctacgtttggtgtaaattgtgtttgcccaggttttgttaaatcagattttaactgcaacattggaatttttaccgtcgaagaaggtgctaaacatgcagtaactatagctcttttaccggatggcggaccttcgggttttttctatgaacgagcacaactatctgcattttga

SEQ ID NO: 814 - DNA, 915 bp, Stylophorum diphyllum
atggcagcagagataaggtctgatcctgaaacaagaaagaggtgtgcagtagttacaggtgccaataaggggattggatttgagatttgtcgacagttagcttctaatggtatctcggtggtattaacatctagagatactaagaggggaactgatgcttttcaaagtctcaaagattctggagtctctggtgtggtttatcatcaacttgatgttatggacccaactagtgttgcttccttggcagatttcattaaaacccaatttggaaagcttgatatcttggtgaataatgcggggattggtgggatcgaagtagactatgatggtttaattgccctaacacgtggggatggtgagctcgaagacaaccccaaatttaaagaagtaatgacacagacctttgagttggcagaagaatgtctaacaacaaattactatggcgttaaagcagtaactgaatcccttattcccttccttcaactatctgattcagcaagagttgttaatgtttcctcctccacggggaagttgaagaacatctccaatgaaaaggctatagaagtatttagtgatgttgatgggttaacagaagggagaatagatgaggtgcttaatgagtatcttaaggattttaaagaggatttgatagaaaccaaaggatggcctacaaagttatctgcatatacaatctcaaaagcagctttgaatgcctacactaggattttagcaaagaaatttcctatgtttcgcataaactgtgtctgtcctggctttgtcaaaaccgatattaactacaatactggagtattgaccgttgaagaaggtgctgcaagtcctgtaagattggctcttttaccagatgacgggccttctggcctcttcttctttcgtgcagaagtatcagacttttga

SEQ ID NO: 815 - DNA, 927 bp, Tinospora cordifolia
atggcagaaatgtcatcagtgttcaacggcagtccggctgctgctaagaggtgcgcagttgttacgggaggcaacaaaggtattgggttcgaggtatgtcgtcagcttgcttccaaaggagttttggtggtgttaacagccagagatgagaagaggggtgttgaagctctccaaaaactagggggttctggaaacgctgatgtggctttccatcaacttgatgtgaccaactctgctaccattgcttctttggttgatttcatcaaaacccaattcgggaagcttgatattttggtgaacaacgctggaatctctggtgctatcataaactatgatttactaaagctagaagaggctagagatgaagaagtggggagacaactagaaatgttactaaaagcacatgaggagacttcagaattagtcgaagaatgtgtaaaaacaaactactatggtaccaaaacagtaacagaagcacttcttcccttattgcaactctccaattctgcgaggattgtcaatgtttcctcctcactgggactgttacagcaaatctcaaatgaacgagctaaggaagtattcaacaatattgatgagcacacagaagagagaatagatgaggtgttgaatgagttcttgattgatcacaagaaaggctcgttacaatccaaaggttggtctaatgatataagtgcttacaaagtttcgaaagcagctatgaatgcctacacaagaattcttgcaaggaagttcccttctttttgcatcaattgtgtttgtcctggttatgtaaaaactgatattacatgtaatactggaatatttactgctgaagagggtgcggaaagcatagttgagttggctttgttgcctatagatgggccttctggcttattttttagtaggaatcaagtatcaggtttttaa

SEQ ID NO: 816 - DNA, 915 bp, Tinospora cordifolia
atggaagaaaacaccttcagttcagcagaaaagaggtgtgcaattgttactggtgccaataaaggaattgggttcgagatatgtcgtcaactggtctctaatggagtcatggtaatattaacagcaagaaatgaggataggggtgccaaagctgttgagactctcagagaatctggcctaagtaatgtggtttttcaccaacttgatataaaggatacgactagtattgctgcgctagtgagcttcatcgaaagccagttcaagaaaattgatattttggtgaacaacgcagctgaaaatggagtaattttagatttcgagggttttaaggcctatgcattagaatataatggaatgatagatgcgaatcctgaaaagcttagtcaacttacggtggaaacttatgagatggcagaggaatgtttgaaaaccaactattatggaaccaaagcagtaaccgaagcccttcttccgtttcttcaactctcagattcaccaagaattgttaacatctcgtccataagtggacaactcaatggtttctccaatgaaaaggttaaagcagagctgaacaatgttgattgcttaattgaagagagaattgatgagttgttgcaacggtttctgaaggatttcaaggagaatatgctgaaagctaatggttggcctcttgtgccttctgcttatagagtctccaaagctgccttaaatgcttacacgagaattctagcaagaaagctcccttcttttcgcataaactgtgtccaccctggttttgtagaaacagacatgtcacatcatacaggagccctcaatgctgaacaaggtgctaaagctcctgtaatgttggctttgctacctcaagatggcccttctggctgctactttgatcagatggaaatgtcaacattttga

SEQ ID NO: 817 - DNA, 894 bp, Xanthoriza simplicissima
atggcagaagagaggtgtgcagttgtgacaggagggaataaaggaataggactagagatatgtcgtcaattagcatcaaatggtatcttggtcatactaactgctagagatgagaaaaggggtactgaagctgttgagaatctaaaggaatctggattttctaatgttgtttaccatcaacttgatgttaaagatccctctagtattgcttctttggcaaatttcatcaatacccgtttcagaaaacttgatatcttggtgaataatgcaggggttggaggagttgtaattgagagtgatgctttcagagctttaaaaaacggatttgaagatgtaagtgatgaaaaccccgataagctgaagggagtaatggaacagacttacgagaagagcgaagaatgtttgaaaaccaactattatggaaccaaaagagttactgaagctcttttgcctgcccttcaactctccaattcagcaagaattgtgaatgtttcgtcatcgtacgggaaactcatgttcatacacaatgagagtgttaaattggagctgagcaactttgagactctaacagaagagcgcatcgacgagcttattctatggtttctaaaggatttcaaggaggataagttgcaggaaaacggttggcctatcactgtatctgcttataaactctccaaagctgctgtaaatgcctacacaagaatgctagctcgaaagttccccaacatgctcataaactgcgtccatcctggttatgtgaaaactgatattaattgtaacacagggttattgactgctgaagaaggcgctaaaggtcctgtaaagatggctttgttacctgataatggcccttctggtcactactttaatcaggtgaacatgtcaacgttttag

SEQ ID NO: 818 - DNA, 816 bp, Argemone mexicana
atggcaggtttggttcgaaaagttcttgttactggaactgcgggtttaacaggtcaaattgtttataagaaattgagggagagaactgaacagtatatcccaaggggtttagtaagatctgaagaacgtaagaataaaatgggaggatcagatgatatttttattggaaatataaaagatgtcaagagtttagtccctgctatccaagggattgatgccctaatcattctcacaagtgctttaccaaaaatcaaacctaaacctggatttataccctcaaaaggtgaaagggctgagaattacgtcagagaagatgggtcatttgatgaaatgcctgagtgctacttcgaagatggtggatcccctgaagaggttgactggataggacagaagaatcaaattgatgttgcaaaggcagctggagtgaagcaaattgttttggttggatccgttggtgggacaatccctaatcaccctttaaacagcctaggaaatgggaatcaactggtttggaaaagaaaagctgagcagtatcttgctgactctggagtaccatacacaataatcagggctggaggtttagaagaaaaaccagggggtttgagggagttgcttgttggtaaagatgatgaacttcttcaacagcctgaattggtagttgtcagcagagccgatgttgcagaagtctgcattcaggcattgcaatttgaggaggcgaaattcaaggcatttgatttgggttcaaaacccgagggaattggttcaccaactaaggatttcagggatcttttctcccaagtcacctctcgtttctaa

SEQ ID NO: 819 - DNA, 810 bp, Argemone mexicana
atggcaaattcaagtgaaaagcttaccgtccttgtaactggagcttccggattaacaggtcacctagcattcaagaaattgaaggagagatcagacaaatttgtggtgaggggtttagttagatcagaagcaagtaaacagaaacttggagggggagatgacatttttattggtgatgtaatggatcctaagagccttgaaccagccatgcatggaattgatgccctaattattctaactagtgctatcccaaagattaaacctggatcacttcctggtgctgatggtaaaagggctgaggatgtaattgacagttcatttgatggtccaatgcctgaattttattatgaagaaggacaatacccagaacaagttgattggattggacagaagaatcaaattgatacagctaaagcttgtggtgttaagcatatagttttggttggatcaatgggtggatcagatcctaatcacttcttgaactacatgggaaatggaaatatactgatctggaagagaaaggctgagcagtatttggctgattctggaatcccatacacaattataagggctggaggcttagataacaaagaaggtggcagggaattgttggttggaaaagatgatgagcttctcccaactgaaaatggatacatttctagggcagatgtggctgaagcttgcgttcaggctttgcagatcgagaatgttaaattcaaagccttcgatttgggatcaaagccagagggagttggtgagccaactaaggatttcaaggctctttttgcctcagttactactccattctga

SEQ ID NO: 820 - DNA, 756 bp, Argemone mexicana
atggcaagtactgttattgttactggtgctggaggtagaactggtcaaattgtttataagaaactgaaagagagaagtgatcagtatcttgcaaggggtttggtcagaacagaagaaagcaaggagaaaattggaggtgctgatgatgtttttgtaggagatataagggatgctgagagtattctccccgcaatcaaaggtgttgatgctcttataattctcacaagtgctgtgccaaagatgaaacctggatttgatccttctaaaggtggaaagcctgagttctattttgaagatggagcttatcctgaacaggttgattggattgggcagaagaatcaaatagatgctggtaaagctgcggaagttaagcatatcgttttggttgggtctatgggtggaacgaacctcaacaatcccttgaatagcatcgggaatggcaatatattgatttggaagagaaaagctgagcaatacctagccgactctggtataccatacacaattattagagctggaggcttacaagataaagaagggggtatcagagagcttgttgttgggaaggatgatgagcttgtccagactgaaataagaaccatcactagggctgatgttgcagaagtctgcattcaggcgttgcagttcgaggaagccaagtttaaagctttggatctagcttcaaagcctgagggaactggtgagccaactaaagatttcaagactctcttctcccaaatctctacccgtttctaa

SEQ ID NO: 821 - DNA, 756 bp, Argemone mexicana
atggcaagtactgttattgttactggtgctggaggtagaactggtcagattgtttataagaaacttaaagagagaacagatcagtatgttgcaaggggtttggttagaacagaagaaagtaaagaaaaaattggaggtgctgatgatgtttttgtaggggatataagggatgctgagagtattgcccctgcaatccaaggagttgatgcccttgtaattctcacaagtgctgtgccaaaaatgaaacctggatttgatcctagtaaaggtggaaggcctgagttctatttcgaagatggagcttatcctgaacaggttgactggattgggcagaagaatcaaatagatgccgctaaagctgcgggagtaaagcagatcgttttggttgggtcaatgggtggaacaaacctcaatcatcccttgaacagccttgggaacggcaatatattagtgtggaagagaaaggcaaagcaatacctagccgactctggtgtaccgtacacaataattagagctggaggtttacaagataaagaaggaggtctgagagagcttgttgttgggaaggatgatgaacttctccagactgacataagaaccatagctagggctgatgttgctgaagtctgcattcaggcattgcagtttgaggaagccaagtttaaagcttttgatctcgcttctaagcccgagggatgtggtgaaccaacaaaagatttcaagactctcttttcccaaatctctacccgtttctaa

SEQ ID NO: 822 - DNA, 762 bp, Berberis thunbergii
atggcgaattcgcaaactgttctcgttactggagctgccggtagaactggtcaaattgtctataagaaattgaaggaaagatcagatcaatatgttgcgaggggcttggttagaacagaagagagcaaagaaaaaattgggggaaaagatgatgtttttgtaggtgatataagggatgctgggagcattgtgcctgctattcagggaatcgatgctctcataattctcaccagtgctgtgccaaagatgaaacctggatttgatccaaccaaaggtgggaggcctgagttctactacgaagagggggctatgcctgagcaggtggactggattggacagaagaatcagatagatgcagctaaagcagtgggtgtcaaacagatcgtcttggttgggtccatgggtgggacaaatcctgataatccattgaacaaaattggagacggtaacatactggtttggaagagaaaggctgagcagtatttagctgactctggtataccatacacgattataaggtctggaggcttacaagataaagaagggggcgtgcgggaactgattgttgcgaaggatgatgaacttgttgcaactgacacaagatcaattcctagggcagatgttgcagaagtctgcattcaggcattacagtttgaggaggcaaagttcaaggcctttgatttggcctcgaagcccgagggtgctggcgaaccaacaaaagatttcaaggctctgttttccaaaatcacaacccgattctga

SEQ ID NO: 823 - DNA, 810 bp, Corydalis chelanthifolia
atggcaacctgcagtcagaaaaaaaccgtccttgttactggtgcttctggtttaactggtcaaatcgtgtacaagaaattgaaggagagaagtgatgagtttgtggtgaggggtttggttagatcagaagcgagtaagcagaaacttggaggaggagatgatatttacattggggatatcaataaaccagaaaccctcgttcctgcattggaaggagttgatgctctcatcatcgttactagtgctatccctaagatcgtacccggaagttgtgccgtagctggtgaaagggctgaagatgttattgacagttcatttgaaggtccaatgcctgatttctattacgaagaaggacaatacccagagcaggttgattggattggccaaaagaatcaagttgatgcagctaaagctgctggagtgaagcacgttgttttggttgcttcaatgggtggactggaccctaaccacttcttgaactacatgggaaatggaatgattttgatttggaagagaaaggctgagcaatatttggctgactctggactcccatacacaatcataaggtctggaggcttggataacaaagcaggaggtcgggaactacttgtggaaaaggatgatgtacttctccctactgaatctggatacattgctagggctgatgttgcagaaacctgcgttcaggcggtgcgacacgaggatctcaccaaattcaaagcatttgatttaggatcaaagccagagggaactggaactcccacaaaggatttcagggctctttttgccccaatcactactactttctga

SEQ ID NO: 824 - DNA, 837 bp, Corydalis chelanthifolia
atggcttgcaagacttgctgcagtaaaatcccatgctttcgtcaaaagaagaccgttcttgtgaccggagctgcaggtttaacaggtaatatggtttataagaagttgaaggagagatcagacttgtttgtagccaggggcttggttcgatcagaagggagtaagaagaaaattggaggacatgatgatgtttttattggagatgtaatggatcctaagagccttgctcctgccatgaaaggaatcgatgcgcttgtcatactaacaagtgctgtaccgaagattaaacccgggtcaggtcccaatactggtaaaagagccgaggacgtaatcgatagttcatttcaaggtccgatgcctgaattctatttcgaagaaggacaatatcctgaacaggttgactggattggacaaaagaatcaaatcgatgcagctaaggctgcaggagtgaagcatattgtgttggttggatcaatgggtggatgtgatcctaatcacttcttgaacagtcttggcaatggaaatattctggtctggaagagaaaatctgaacagtatctggctgactctggagttccatacacgataataagggctggaggcttagaaaacaaagcgggtggtcgggaactgttggttggaaagaatgatgagcttcttccaactgaagcagggtacatatcgagggcagatgttgcagaagcttgcgttcaggccgtgcagtttgaggaggtcaccaaattcaaagcatttgatttaggatcaaagccagagggaactggaactcctaccaaggatttcaaggctcttttctccctggtcactgctcgtttctaa

SEQ ID NO: 825 - DNA, 819 bp, Corydalis chelanthifolia
atggtaacctgcagctgcacccaaaagaagaccgtccttgttaccggagcctccggtttaacgggttcaattgtatacaagaaattgaaggagagatcagacaagtttgtggtgaagggtttggttagatcagaagcaagcaagcaaaaaattggaggtggagatgatgatgtttgttttggagatatcatgaaaccagagaccctcattcctgcaatggaaggagttgatgctctcatcatccttagcagtgctgtccctaagatcgtacccggaacttgtgccatagctggtgaaagggctgaagatgtcattgacagttcatttgaaggtccaatgcctgatttctattacgaagaaggacaatacccagagcaggttgactggattggccaaaagaatcaagttgatgcagccaaagctgctggagtgaagcacgttgttttggttgcatcaatgggtggaatggaccctaaccacttcttgaactacatgggaaatggaatgattttgatttggaagagaaaggctgaacagtatttggctgactctggattgccatacacaatcataagggctggagggttagataacaaagtaggaggtcgggaactagtcgtaggaaaggaggatgagcttctaccaaccgaatcagcatacattgctagagctgatgttgctgaagcttgtattcaggcactacagtttgaggaatatgtcaagttcaaggcatttgatttgggatcaaagcccgagggaatgggtactcccacaacagatttcggtgctcttttcaccccaatcactactactttctga

SEQ ID NO: 826 - DNA, 828 bp, Corydalis chelanthifolia
atggcagaatcagatcgaaagacaactgtgcttcttactggagctgccggtgcaactgggaaattcgtatttaagaaattgaaggagagatcagagaaatatgtggtaaggggtttagtaagatcaatagagagtaagaaaaaattgggagaaaacgtaaatgatgatgatgtttaccttggggatatccaaaaaccagaaaccctaattcctgctctccaaggagttgatgctcttatcattcttacaagtgctatagcaaaggttaaaccagggcaaaacccaaccagaggtgatcgagctgagaattacttcaatgaagatggatcattggctgaagatatgcctgagttccacttcccaccaggatcaattcctgaagaggttgattggattggacaaaagaatcaaattgatgcagccataacagctggagttaagcatattatagtggttggatccatatgtggaaccattcctgagcaccccttgaacactataggcaatggtgatatactgctttggaagagaaaggctgagaagtacttaactgaatctggagttccatacacgattataagggctggagctttagatgataaagaaggaggtgttcgagaattactagttggtaaggatgacgaggtggtttatcagatggaaaatatatacatttcaagggatgatgttgctgaaacctgcatccaggcactgcagtttgaggaggccaaattcaaagcatttgatctcacatcaaagcctgagggaactggtacaccaacaaaggatttcaaggctcttttttctcaagctaccgctcgtttctaa

SEQ ID NO: 827 - DNA, 813 bp, Corydalis chelanthifolia
atggatgattcatacaggaaaactgtccttgttactggggcatctggtgcaactggccaaattgcttataacaaattgaaggagagaccagagcagtttgttgcacgaggttttgttagatcagaagctagtaagaagaaaataggaggaggagataatgtttttctagggaatgtaatggatgctgacagtattattcctgcagttgaaggaattgatgctctcataattctaaccagcgctatcccaaagatgaaacccggagttggtttttctaacgaaggtgaaagagctgaagacgtgatcgatggttcatttgaaggtccaatgcctgaattctatttcgaagaaggacagttccccgaacagattgactggatagggcagagaaatcaaatagatgcagctaaagctgctggagtgaagcatattgttttggttgggtctatgggtgggagcgatcctaatcatcctttgaacactctagggaacgggaatatactggtttggaagagaaaagctgagcagtacctcgctgattctggggtgccatacactatcataagggctggaggcttaataaataaaccaggtggtctgagagaattacttattgggaagaatgatgagcttcttccaactgaatcaggatacgtccccagggaagatgtcgcagaagtctgtgttcaagcattgcagtttgaggaatatgtcaagttcaaggcatttgatctgggctcgaagcctgagggaactggtactccaacaaaggacttcaaggctcttttctcccaagtcactagacgcttctga

SEQ ID NO: 828 - DNA, 810 bp, Chelidonium majus
atggaaggttcaagccaaaagatcaccgtccttgtcaccggagcttctggattaaccggtaatcttgcattcagtaaattgaaggaaagatcagacaagtttgtggtgaggggtttggtaagatcagaagcaagtaaacagaaacttggaggtggagatgagatttacattggtgatataaaggatgctgagagccttgttcctgccatgacaggaattgatggtctcattattctgacttctgctatcccaaaaattgtacctggatcaatgcctgatactgaaggtaaaagatctgaagatgtaatcgacggttcattcgaaggccccatgcccgaattctattacgacgaagggcaatacccagaacaggttgattggattggacagaagaatcaaattgatacagctaaatctttgggagttaagcatgttgtgttggttgcatcaatgggtggacaagacccaaatcatttcttgaactatatgggaaatgggaacattttgatttggaagagaaaggcagagcagtatttagctgactctggtttaccttacaccataattagagctggaggattggataacaaacaaggaggtagggaattgttggttgataaagatgatgtgcttctccctactgaaaatggatacattgctagagcagatgttgctgaagcttgtgttcaggcattacaatgtgaagagactaaattcaaggcgtttgatttggggtcgaagccggagggaactggtacacccacaacggattttaaggctcttttcgccccaattactactagcttctga

SEQ ID NO: 829 - DNA, 849 bp, Chelidonium majus
atggcttgcaaaagttgttgcagcaaagtgcttacggcctgctcaaccccaaagaaaactgtccttgttacaggagcttctggcttaactggtcgatttgcatttaacaaattgaaggagagaccagacaagtatgttgcaaggggtttggttagatcagaagcaagtaaacagaaacttggtggaggagatgagatttatattggggatgtcatggatcagaagagtcttgaacctgccatgaaaggagttgatgctcttatcattcttacctctgctactccaaagatggtacctggacaattccctgaaggtagtggtgaaaggggtgaggatttaattgatggatcatttgaaggtccaatgcctgagttctattttgatgaaggtcaaacccctgaacgggttgattggattggacagaagaatcaaattcatgcagctaaagctgcaggagtgaagcatattattttggtttcatctatgggttctggagatcctaatcaccctttgaacagtcttggaaatggaaatatactggcttggaagagaaagtctgaagagtatttggctaattctggagtaccatacactattataagggctggaggtttagataacaaagacggaggaaaaagggagttgttggttgggaaaaatgatgagcttcttcctactgaaaaaggatacattgctagggcagatgttgcagaagcttgtgtccaggccgtgctcttttttgatgagctcaaaaacaaagcattcgatctagggtcgatgccagagggaactagtacccctactaaggatttcaaggctcttttcgccccaattactactagcttctga

SEQ ID NO: 830 - DNA, 804 bp, Chelidonium majus
atggatgattcacgtcgaaaaactgtccttgttactggtgcttccggtgcaacaggcaaacttgcttacgacaaactgaaggaaagacctgatcagttcgtcgcgaggggtttcgttaggtcggaaaacagtaggaagaaaattggaggtggagatggtgtttttattggagatgtacagaatgcggagagcattgttcctgctgtccaaggaattgatgctctcataattctcacaagtgctatcccaaaaataaaacctggggttgttcccgacgaaggccaaaaggctgagaagtatatagattcatcatttgaatcaatgcctgagttctactatgatgaaggccaatacccagaacaggttgactggattgggcagaaaaatcaaatagatgcagctagagctgctggagtgaagcatattattttggtttcatctatgggttctggagatcctaatcaccctttgaacagcttagggaatggaaatatattgatctggaagagaaaggctgagcagtatctggctgattctggagtaccatacacaataataagagcgggaggtctaattgacaatccaggaggtatgagagaactacttattgggaggaatgatgagcttcttccaactgaagatggatatgtccctagagcagacgttgcagaagtgtgtgttcaggcaacgcagtttgaggagaccaaattcaaggcttttgatctaggctcaaagccggaagggaaaggtacacccaccaaagatttcaaggctctcttttccaaactcactgatcgcttctaa

SEQ ID NO: 831 - DNA, 813 bp, Chelidonium majus
atggcagattctgatcgaaaaaaaatccttgttactggagctgctggttcaactggaaatcttgcttacargaaattgaaagagaggacagagaagtatgtagcaaggggtttggtaagatcagaagaaagtaagaaaagaattggaggagcagatgatgtttttataggaaatataagggatgcccagaccttagttccagcagttgaagggattgatggtcttataattcttacaagttcattgcttaagatcagaccaggatctgctgcaccaaaaggtgataaggctgagtattacatgttagaagatggttcatttgatcctgacatgcctgagttttactatgaagaatctcctgaacaggttgattggattgggcagaagaatcaaattgatgcagctaaagctgctggggtgaagcatattgttttggttggatcaatgggtggaacagacccaaatcaacccttgaacagtctaggagacaatggaaattttctgatttggaaaagaaaatctgagcaatatcttgctgactctggaataccatacacaattataaggtgtggaggtcttgatgataaagaaggaggaaagagggaattacttgtgtcaaaagatgatgaaatgttttctcagattgaacttatatatatttcgagggatgatgttgcagaagtctgtattcaggcattcgagtgtgaggaggccaaattcaaggcgtttgatctgacatcaaagccggagggaactggtactccaacaagggacttcaaggctcttttcgcacaagttactactcgtttctga

SEQ ID NO: 832 - DNA, 816 bp, Chelidonium majus
atggataattctgatcgaaaaacagtccttgttactggtgctagtggtgtaactggaaatctcgcttataagaaattgatgcagagaacagataagtatgtgggaaggggttttgtaagatcagaagcaagtaaggaaaaaattggtgggacagataatgtctttatagggaatataaatgatccacagaccttagtccctgcagtacaaggaattgatgctcttataattcttacaagttctatgcttaagatcaaaccagggtctgctgcaccaaaaggtgacaagcctgataattactttaatgaagatggttcatttgatcctgacatgcctgagttttactatgaagatggaaattctcctgaagaggttgattggattgggcagaagaatcaaattgatgcagctaaagctgctggggtgaagcatattgttttggttggaactatgtgtggaacattcccaaatcatccagtgaacattcttggaaatggaaatatgctggtttggaagagaaagtctgagcagtatctagctgactctggaattccatacacaattataagggctggtggtttagatgataaagaaggaggcctgagggagatagttttctcaaaggatgatgaaatgtttgctgacattaacatgatatatatctctagggatgatgttgcagaagtctgcattcaggcactggaatgtgatgatgccaaattcaaggcgtttgatctgacatcaaatccagagggaaccggtacaccaacaacagacttgaaggctcttttctcacaagttactactcgtttctga

SEQ ID NO: 833 - DNA, 813 bp, Chelidonium majus
atggatgattcacgtcgaaaaactgtccttgttactggtgcttccggtgcaacaggcaaacttgcttacgacaaactgaaggaaagacctgatcagttcgtcgcgaggggtttcgttaggtcggaaaacagtaggaagaaaattggaggtggagatggtgtttttattggagatgtacagaatgcggagagcattgttcctgctgtccaaggaattgatgctctcatgattctaacaagtgctgtaccaaagatcaaacccgagtttttgatacccaccaaaggtgaaagggctgagaattacgttactgaaggtgcatcatttgaatctgtacctgagttctactatgatgaaggacaattcccagaacaggttgactggattgggcagaaaaaccaaatagatgtagctagagctgctggagtgaagcatattattttggtagggtctgtgggtgggacagaccctaatcaccccttgaacagcttagggaatggaaatatattgatctggaagagaaaggctgagcagtatctggctgattctggagtaccatacacaataataagagcggggggtctacttgacagtccaggaggcatgcgagaactacgtattgggaggaatgatgagcttcttaaaactgaagatggatctgtccctagagaagatgttgcagatgtgtgtgttcaggcaacgcagtttgaggagaccaaattcaaggcttttgatctaggctcaaagccggaagggaaaggtacacccaccaaagatttcaaggctctcttttcccaactcactgatcgcttctga

SEQ ID NO: 834 - DNA, 809 bp, Chelidonium majus
atggcagaatcacagaaaaagatgaccgtccttgttaccggagcttccggattaaccggtcaacttgcattcaagaattgaaggagagatcagacaagtttgtagtgaggggtttggttagatcagaagcaagtaagcagaaacttggaggaggagatgagatttttattggggatattctaaatgaagagagccttgttcctgccatgacaggaattgatggtctcatcattctcacctctgctatcccaagaattgtacctggatccatgcctgatactgaaggtaaaagggctgaagatgtagttgatggttcatttgaaggccccatgcccgagttttattatgaggagggtcaatacccagaacaggttgattggattggacagaagaatcaaattgatacagctaaatctttgggagtcaagcatattgtgttgattggatcaatgggtggacaagaccctaatcatttcttgaactacatgggaaatggaaacattttgatttggaagagaaaggctgagcagtacctggctgactctggagtcccatacacaattataagggctggaggcttagataacaaagaagggggtagacaattgttggttggacagaatgatgagcttctccctactgaagatggatacattgccagggcagatgtcgctgaagcttgcattcaggctctgcagattgaggagtctaaattcaaagcattggatttggggtcaaagccagagggagttggtgagctcaccaaggatttcaagcctcttttcgcctcagtcactactcgtttctga

SEQ ID NO: 835 - DNA, 768 bp, Cissampelos mucronata
atggcggatcttcccagaaccacggttcttgtcaccggcgctggtggccgaaccggtcagattgtttacaagaaattgaaggagagaagggatcagtatgcggcaagagggctggttaggacagaagaaagcaaggaaaaaattgggggtgcagatgatgtgtttgttggggatataagggaggctgagagaattgttcctgcaattcaaggaattgatgctctcataattctcaccagtgctgtgcccaagatgaaacccgggttggatccgagcaaaggtggaagacctgagttttattttgaagatggtgcttttcctgaacaggtagattggattgggcagaagaatcaaattgatgctgccaaagatgcaggggtgaagcagattgtgttggttgggtctatgggtgggacaaatcctaaccatcccttgaacagcattggaaatggaaatatattggtctggaaaagaaaggctgagcagtatttagccgactcgggcgttccatacacgattataagggctggaggcttacaagataaagaaggcggcgtgagggagctacttatcagcaaagatgatgagcttcttagcaccgagacgagaaccatcgccagagcagacgttgcagaagtctgcattcaggcattgcagtatgaggaatcaaaattcaaggcttttgatttggcctctaaacccgagggaactggcgagccaacgaaagatttcaaggctcttttctcgaagatcaccacccgtttttaa

SEQ ID NO: 836 - DNA, 822 bp, Eschscholzia californica
atggcagattcatctaaaaagcttactgttcttgtttcaggagcttctgggttaactggttctcttgcattcaagaaattgaaagaaagatcagacaaatttgaggttaggggtttggttagatcagaagcaagtaaacaaaaacttggtggaggagatgaaatattcattggtgatatttcagatcctaaaaccctagaaccagctatggaaggaattgatgctttgataattctaacaagtgctatacctaggatgaaaccaactgaggaatttactgctgaaatgattagtggtggaagatcagaagatgtgattgatgcatcattttcaggtccaatgcctgaattttattatgatgaaggacaatacccagaacaagttgattggattggacagaagaatcaaattgatactgctaaaaaaatgggtgttaaacatattgttcttgttggatctatgggtggatgtgaccctgatcacttcttgaatcatatgggaaatggaaatattttgatttggaagagaaaggctgagcaatatttggctgattctggagtcccatacactatcattagggctggagggttagataacaaagccggtggagtaagggaattgttggttgctaaggatgatgtcttgcttcctactgaaaacgggttcatcgctagggccgatgttgctgaagcttgcgttcaggctttggagattgaggaagtgaagaacaaagcatttgatttggggtcaaagccagaaggagttggtgaagccacaaaggatttcaaggctctattttctcaagttactactcctttttga

SEQ ID NO: 837 - DNA, 822 bp, Eschscholzia californica
atggagggttcatgtcaaaaaataactgtccttgttactggagcttctggattaacaggtcaacttgcatacaagaaattgaaggaaagatcagaacagtttgaggtaaggggtttggttagatcagaagcaagcaagcagaagcttggaggaggaaatgaaatcttcattggagatataatggatgctaaaacccttgaacctgccatgaaaggaattgatgctcttatcattcttaccagtgccatcccaaagatgaaaccttctgatgaatttcccgctgaaagttgtagtactggaagagctgaagacatgatcgacggatcatttgacgggccaatgcctgaattctactttgaagatgggcaatacccagagcaagttgattggattggacagaagaatcaaattgatacagctaaagctcttggagttaagcacattgtactagtcggatctatgggtggatcggacccgaaccatttcttgaacagtcttggaaatggaaatatattgatatggaagaggaaagcagagaagtatttggctgattctgggttggcttataccattatcagagctggaggtttggataataaagaaggcggtataagagagttgttaattgggaaagatgatgttcttctccctaccgaaaatggatatattgctagggctgatgttgctgaagcttgtattcaggctctgaagattgaggaggtgaaatttaaggcctttgatttggggtcaaagcctgagggaactggtgttccgactaaagattttggtgctcttttctcccccattaccgagcgtttctaa

SEQ ID NO: 838 - DNA, 822 bp, Eschscholzia californica
atggaaggctcatgtcaaaagatgaccgttcttgtcacgggagcttctgggttaaccggacaacttgcatacaaaaaattgaaggaaagatcagagcagtttgtggtgaggggtctggttagatctgaagcaagtaagcagaagcttggaggaggagatgatatcttcattggggatattatgaattgtcaaaccctagaacaggccatgaaaggaattgatggtctcatcattctcacaagtgctatcccaaagatgaaacctactgatgaatttccagctgaaagtttgggtagtggaagagctgaagatatgatcgatggatcgtttgacggaccaatgcccgagttctatttcgaagaaggacaatacccagaacaagtcgattggattggacaaaagaatcaaattgatacagctaaagctcttggagttaaacatgtagttctagttggatcgatgggtggatcggatccaaaacatttcttgaacagtcttggaaatggaaatatacttatatggaagagaaaagcagagcaatatctggctgactctggtttggcatacaccattatcagagctggaggtttggataacaaagaaggtggaataagagagttgttggtagggaaagacgatcttcttcttccaactgagaatggatatattgctagagctgatgttgctgaagcttgtgttcaagctcttcaatttgagaatgtcaaattcaaagcatttgatttgggatcaaaaccagagggaaatggtgaacccacaaaggatttcggtgctcttttcgcccctatttccgaacgtttctaa

SEQ ID NO: 839 - DNA, 855 bp, Eschscholzia californica
atggcttgtaaaacttcttgtagtaagttgatggcaacctgttgctcttccaagaaaactgtcctcgttacgggtgcttccggtcttactggtcaatttgcttttaacaagttgaaagaaagatcagacaaatttgtagtaaggggattggtaagatcagaaggaagtaagaaaaaacttggaggaggagatgaaatttatataggaaatgttatggatcctaaaacccttgaaccagccatgaaaggagtagatgctttaatcatacttaccagtgctatacccaagatgaaacctggtcaattccctgaaaatagtaatgggggtggaagagctgaagatatgattgatggatcatttgaaggtccaatgcctgaattctactttgatgaaggacaattcccagaacaggttgattggattggacagaagaatcaaattgatgtagctaaagcttgtggagttaaacatattgttttgatttcatcaatgggttctggtgaccctaatcatcctttgaacagtcttggtaatggaaacatattggcttggaagaggaaatctgaagagtatttatctaattgtggtgttccatacactataataagagctggaggattggataacaaagatggagggattcggcagttgttggtggggaagaatgatgagcttcttcctactgaaaaagggtatattgctcgagcagatgttgcagaagcttgtgttcaggcggtacagtttgaggagctagtgaagttcaaagcatttgatttaggatcaatgccagagggaactggtactcctacaaaggatttcaaagctcttttcacccctataacagctcgtttttga

SEQ ID NO: 840 - DNA, 804 bp, Eschscholzia californica
atggatgattctcgtcctaaaactgttcttgtcactggtgcttctggtgccactggtcaaattgcttataataagctgaaggaaagacctgaacaatttatagctaggggttttgttaggtcagaacaaagtaagaagaaaattggaggtggagatgatgtatttttaggaaatataatggattcaaatactattgttcctgcagttcaaggaattgatgccctaattattctaactagtgctataccaaaaataaaacctggggtgtttccaaatgaaggtgaaaaagctgaaaaatatattgatagttcatttgaatcaatgcctgagttctattttgatgaaggacaatacccagaacaaattgattggataggccaaaagaatcaaatagatgcagctagagctgctggagtgaagcacattattttggttggctcggtgggtggatcagaccctaatcatccattaaacagcttaggcaatggaaatatactggtttggaagaggaaagctgaggaatatctggctgaatctggagttccgtatactataataagggctgggggtctaatcgacaatccaggaggtatgcgggagcttctagtcgggaaggacgatgagtttcttcctactgaaaatggatatgttcccagagcagatgtcgcagaagtttgtgttcaggcagtgaagtttgaggaagcgaagtttaagacatttgatcttgggtcgaagccagagggaaaaggaaaaccgacgacggatttcaaggctcttttctcccaagtcactactcgcttttga

SEQ ID NO: 841 - DNA, 840 bp, Eschscholzia californica
atggctgcttctgatttaggtgggaaaaaaacagtccttgttacaggagctgctggattaactgggagattggtgtttaagaaattgaaagaaagatcagataagtatgtagtaaggggtttggttagatcagaagaaagtaagaaaaagattggaagtgggttatcagatgatgaagaagaaatattcattggggatattaaagattcccaaactctaattcctgctatgaaaggaattgatgcactcattatcctaacaagtgctttgccaaaggttaaacctggacctgctgcaaatagaggtgatagggctgagtattatgttaatgaagatggttctttccctgatcccatgcctgaaatttactatgaacaaggaaattatcctgaacaggttgactggattggacaaaagaatcaaattgatacagctatagctgctggagtgaaacagattgttttgattggatctatgtgtggaacagatccagataacttcttgaacaaatatggaaatggaaatatactggtttggaaaagaaaatctgagaagtatctgtctgagtctggagttcctcacacaattataagagctggaggtttagatgatcttgaaggaggtctaagagaattgcaagtctccaaggatgatgagatgatggctcacattgaaaatattatgatttctagggctgatgttgcagaagtcgccgttcaggcattagagcatgaggaagcaaaattcaaggcgtttgatctaacttcaaaacctgtgggaacgggtacaccaaacaaggacttcaaggctctttttgctcaaactactgtccctttctga

SEQ ID NO: 842 - DNA, 810 bp, Glaucium flavum
atggcagaatcacaagaaaagatgaccgtccttgtcaccggagcctcaggattaaccggtcaacttgcattcaagaaattgaaagagagatcagacaagtttgtagtgaggggtttggtaagatcagaagctagtaagcaaaaacttggaggaggagatgatatttttattggtgatatattgaatgcagagagccttgttccagccatgacaggaattgatggtctcatcattctaacttctgctatcccaaaaattgtacctgggtcttttcctgatactgatggtaaaagagccgaagacgtcgtcgacggttcatttgaaggtccgatgcccgatttctattacgaagaaggacaatacccagaacaagttgattggattggacagaagaatcaaattgatacagctaaatctttgggtgttaaacatattgtgttgattgcatcgatgggtggacaagaccctaatcatttcttgaactatatgggtaatggaaacattttgatttggaagagaaaggctgagcagtatctcgctgactgcggagtcccttacacaatcataagggctggaggcctagacaacaaagaagggggtagggagctgttggttggaaggaatgatgagcttctccctactgagaatggatacatttctcgggcagatgtcgccgaagcttgtgttcaggctctgcagattgaggaatccaaattcaaggcattggatttgggatcaaagccagagggagttggtgagcccaccaaggatttcaagtctcttttcgcctcagtcactgatcgtttctga

SEQ ID NO: 843 - DNA, 810 bp, Glaucium flavum
atggatagttcaagccaaaagatgaccgtcctcgtcaccggagcttctgggttaaccggtagccttgcatacaataaattgaaggagagatcagacaagtttgtagtgaggggtttggtcagatcggaagcaagtaaacagaaacttggaggaggagatgatatttttatcggcgacataatgaatgcggagagccttgttccagccatgacaggcgttgatggtctcatcattctaacctctgctgtcccaaaaattgttcctggatccttccctaatgctgatggtaaaagggctgaagacgtactcgacggtgcattcgacggtccaatgcccgatttctattacgaagagggtcaattaccagaacaagttgattggattggacagaagaatcaaattgatacagctaaagccttgggtgttaagcatgtcgtgttgattggatcaatgggtggacaagatcctaatcatttcctgaactatatgggtaatggcatgattttgatatggaagagaaaggctgaacaatatctggctgactctggattaccttacactataattagagctggaggattagataacaaacaaggaggtagggaattgttggttgataaggatgatgtgcttctccctactgaaaatggttacattgctcgggcagatgtcgccgaagcttgcatacaggctttgcagtgtgaagagactaaattcaaggcatttgatttgggatcaaaaccagagggaactgggacaccaacaactgactttaaggctcttttcgcacccatcaccgctcggttttga

SEQ ID NO: 844 - DNA, 843 bp, Glaucium flavum
atggcttgcaaaagttgttgcagcaaactggtcgccgcctgttcatctaagaaaactgtccttgttaccggcgcttccggcttaactggacaatttgcttttaacaaattgaaggagagatcggacaagtatgtggttagaggtttggtaagatcagaaggaagtaagaagaaacttggtggaggagatgagatttatattggaaatgttatggatcagaagagtcttgaacctgccatgaaaggagtggatgctcttatcattcttacaagtgctatcccaaagatgaaacctgggcagtttcctgaaggtagtggtggaagagctgaggatatgattgatggatcatttgaaggtccaatgcctgaattctattttgatgaaggacaataccctgaacaagttgattggattggacagaagaatcaaattgaagctgctaaagctgctggagtgaagcatattattttggtttcttctatgggttctggagaccctaatcacccattgaacagtcttggaaatggaaatatactggcttggaagagaaaggctgaagagtatctggctggttctggagttccatacactataataagggctggaggcttagataacaaacaaggaggcataagagaattgttggttgggaagaatgatgagcttctccctactgagaaaggatacattgccagggaagatgttgctgaagcttgtgttcaggccgtgctgtatgatgaggttaaatttaaagcattcgatctaggatcaatgccagagggaactggtaccccaactaaggatttcaaggctcttttcgccccaattactactagtttctga

SEQ ID NO: 845 - DNA, 804 bp, Glaucium flavum
atggatgattctcgtcggaaaactgtccttgttactggcgcttctggtgcaactggacaaattgcttataacaaattaaaggagagacctgatcaattcattgcaaggggttttgtaagatcggaaaacagtaagcagaaaattggatgtggggaaggtgtttttataggagatatacagaaagctgagagcattgttccagcagttcaaggaattgatgctcttataattcttacaagtgctatcccaaaaataaaacctgggcttgttcctgacaaaggcgaaaaggctgagaagtatatagatggatcatttgaatcaatgcctgagttctactttgatgaaggacaatacccagaacaggttgattggatagggcagaaaaatcaaatagatgcagctagagctgctggggtgaagcatattattttggttgggtctgcgggtgggacggaccctaatcaccctttgaacagcttaggcaatggaaatatactgatctggaagagaaaggctgagcaatatctggctgagtctggagtaccatacacaataatcagagctggaggtctcattgacaacccaggaggtatgagagaactagttgttgggaggaatgatgagcttcttccaaccgaaaatggttacgtccctagagcagatgttgcagaagtctgtgttcaggcaacacaatttgaggaggctaaattcaaggcatttgatttaggctcaaagcctgaagggaaaggtacacccaccaaggatttcaaggctctcttttcccaagtcagtgatcgcttctga

SEQ ID NO: 846 - DNA, 816 bp, Glaucium flavum
atggtagaatctggtcgaaaaacagtccttgttactggagctgctggtttaactggaaaacttgcttataagaaactgaaagagagaacagaaaagtatgtgggaaggggttttgtaagatcagaagaaagtaagaaaagaattggaggagcagatgatgtttttatagggaatataaaggatgcccagactttaattcctgctgtccaaggaattcatggtcttataattcttacaagttgttcagctaaggtaaaacctggatgtgctgcacctaaaggtgatagacctgagaattatattttagaagatggttcactagatcctgatatccctgaattttactttgaagatggagcttctcctgaggaggtcgattggattgggcagaagaatcaaattgatgcagctaaagctgctggagtgaagcatattgttttggttggaggaatgggtggaatggatccatacagtcccttgagcaattttggaaacggaaatgtactagtttggaaaagaaaggctgagcagtatctggctgactctggaatcccatacacaattataagggctggaggtctagaggataaagaaggaggaagaagggagttacttgtgtcaaaggatgatgaaatgttttctcagatggaaatggcgtacatctccagggatgatgttgcagaagtctgcattcaggcactggaatgtgaggaagccaagttcaaggcgtttgatctaacatcaaagccagagggaaccggtaaaccgacaagggacttcaaggctcttttctcacaagttactactcgtttttga

SEQ ID NO: 847 - DNA, 813 bp, Glaucium flavum
atggtaggcttacttcgacgcacagttctcgttactggcgctgctggtttaacaggtcaaattgtatataacaaattgagggaaagggtcacacaatatatcccaagggctttggtaagatccgaagaacgtaaaaggaagataggaggatctgatgatgttttcattggggatataactgatgccaagagtatcattcctgctattcaaggaattgatgcactaatagttctaacaagtgctgtaccaaagatcaaacccggttacgtaccaacgaaaggtgaaagggctgaaaactatattgaggacgatggatcgtttgacgaaatgcctgaattctactttgaagatggtggggaacctgaacaggtcgactggatagggcagaggaatcaaatagatgcagcaaaagcagctggcgtaaagcagattgttttggttggttcaatgtgcggaacaattcctaaccaccctttgaatagcctaggaaatgggaatatactggtttggaagagaaaagctgagcagtatctcgccgactcaggagtaccatacacaataatcagggctggaggattagaagacaaagcagggggtctgcgggagttgattgttggtcaggatgatgatctgcttcaacaacctgtattagcagatatcaccagggctgacgtcgcagaagtctgcattcaggctctgcagtttgaggaggccaaattcaaggcatttgatttgggctcaaagcctgagggaaccggtttcccgacaaatgatttcaaggcccttttttgccaggtcactgctcatttttga

SEQ ID NO: 848 - DNA, 762 bp, Jeffersonia diphylla
atggcaactttgcccactgttcttgttactggagctggtggtagaactggtcaaattgtttataagaaattgaaggaaaaagtagatcagtatgtcgctagaggtttggtaagaacagaagagagcaaggagaaaattggtggagcagatgacgtgtttgtagggaacattacagatgctgagagcattgttcctgcctttcaaggaattgatgctctcataattctcaccagtgctgtaccaaagatgaaacctggatttgatccaagcaaaggcgggagacccgaattctattttgaagacggagcttatcctgaacaggtggactggattggacagaaaaatcaaattgatgctgctaaggccgtaggtgtgaagcaaattgttttggtgggatccatgggcggtaccaatcttgataaccccttgaacagcttaggcaatgggaaaattctggtctggaagcgaaaggcggagcagtatttagccgactctggcataccatacacaattataaggtccggaggcttacaagataaagaagggggggtgcgcgaattgctagttgggaaggatgatgaactcgttaaaactgatacgaggacaattgctagagcagatgttgcagaagtctgtgttcaggcattgcaatttgaggaggcaaaattcaaggcatttgatttggcttcaaaacctgagggaactggcgagccaacaaaagatttcaagggtctcttctccaagatcactaccactttctga

SEQ ID NO: 849 - DNA, 762 bp, Mahonia aquifolium
atggcggatttgcaaactgttctcgttactggagctgccggtagaactggtcaaattgtctataagaaattgaaggaaagatcagatcaatatgttgcgaggggcttggttagaacagaagagagcaaagaaaaaattgggggaaaagatgatgtttttgtaggtgatataagggatgctgggagcattgtgcctgctgttcagggaatcgatgctctcataattctcaccagtgctgtgccaaagatgaaacctggatttgatccaaccaaaggtgggaggcctgagttctacttcgaagagggggctatgcctgagcaggtggactggattggacagaagaatcagatagatgcagctaaagcggtgggtgtcaaacagatcgtcttggttgggtccatgggtgggacaaatcctgataatccgttgaacaaaattggagacggtaacatactggtttggaagagaaaggctgagcagtatttagctgactctggtataccatacacgattataagggctggaggcttacaagataaagaagggggtgtgcgggaactgattgttgcgaaggatgatgaacttgttacaactgacacaagatcaattcctagggcagatgttgcagaagtctgtattcaggcattacagtttgaggaggcaaagttcaaggcatttgatttggcctctaagcccgagggtgctggcgaaccaacaaaagatttcaaggctctgttttccaaaatcacaacccgattctga

SEQ ID NO: 850 - DNA, 768 bp, Menispermum canadense
atggcgaatctgactcgaattactgttctcgttactggagctgggggcagaactggtcaaattgtttataggaaattgaaggagagagcagatcaatatcttgcaagaggtttggttagaacagaagaaagcaaggacaaaattgggggtgcagatgatgtttttgttggggatataagggatgctgaaagcatctaccctgtaattcaaggaattgatgctctcataattctcagcagtgctgtgccaaagatgaaacctggatacgatcctagcacaggtggaaggcctgagttcatttttgaagatggcgctaatccagaacaggttgactggattgggcagaaaaatcaaatagatgcagctaaagatgcaggagtgaagcagattgtgttagttggctctgtgggcggtactaaccctaactactccttgaacagcatgggaaatgggaacatactggtctggaagagaaaggctgaacagtatttagctgactctggtataccatacacaataataagggctggaggcttacaagataaagaagggggtgtgagagagctactagtcggcaaggatgatgaacttctaaacactgaaacaataaaaatcgctagggcagatgttgcagaagtctgcattcaggcattgcagtttgaggaggcgaaatacaaagcatttgatctggcctcaaagcctgaggggaccggtgaaccaacgagaaacttcaaggctctgttctcccaaatcactagccgtttttaa

SEQ ID NO: 851 - DNA, 762 bp, Nandina domestica
atggcgggtttaccaactgttcttgtcactggagctggcggtagaactggtcagattgtctataagaaattgaaggaaagagcagatcagtatgccgctaggggtctggttagaacagaagagagcaaagagaagattggggccgcagatgatgttttcgtaggagatataagggatgccagcagcattgttcctgctatccaaggaattgatgctctcataattctcaccagtgctgtaccaaagatgaaacctggatttgatccaagcaaaggtgggaggcctgagttctattatgaagatggagcttttcctgagcaggtggactggattggacagaagaatcaaatagatgcagccaaagccgtgggcgtgaagcagatcgtattggttgggtccatgggtgggacaaatcttgatcacccgttgaacaacataggaaatgggaagatactggtttggaagagaaaggctgaacagtatttagctgactctggtataccatacacaattataagggcagcaggcttacaagataaagaaggaggtgtgcgagagttagtcgtagggaaggatgatgaacttcttcaaactgaaacaagagcaatcgctagggcagatgtcgcagaagtctgcattcaggcattgcaatttgaggaggcaaagttcaaggcatttgatttggcctcaaagccagagggaactggtcagccaacaaaagatttcaaggctctcttctctaaaatcactacccgtttttga

SEQ ID NO: 852 - DNA, 798 bp, Nandina domestica
atggcggcatccttgcgtcgaagtacggttcttgtcactggtgctggtggtcgaactggtgaaagcgtctacaagaaactgaaggaaagagcggagcaatatctatgcagagctttggtaagaagagaagagagtaagaagaaaattggaggaggagatgatgtctttcttggggatattcgcaatttcaaaaccattttgcctgcatttcaaggtattgatgctttgttaattctaacaagtgctgtacccaaaatcaaacctggttatgtttccagcaaacaagggccctatcagtattttgaaaatggtggatccaactattactatgaagagggagcttaccccgaacaggttgattgggttgggcagaagaatcaaatagatgcagctaaagctgtgggagtgaagcagattgtattggttggatctgtgggtggtacaatacccaaccatcccttgaactccataggaaatgggaatatattggtgtggaagaggaaggctgaacgttatttggctgacactggcttaccatatacaataataagacctggacccttagatgataacgaagggggccaatgcgagttagttgttggaaaggatgatgagttccctgagaatgcagaaataggaaccgttgctagggctgacgttgcggaagtctgtgttcaggcgctacaatttgaggaggccaaattcacggcatttgatctgctctcgaagcctaagggagtaggtacgcctacaaaagatttcaaggcttttttctccaaaatcaccactcagttctga

SEQ ID NO: 853 - DNA, 771 bp, Nigella sativa
atggccgctgattcttctcggagcactgttcttgtcaccggagccggtggtagaaccggtcaaattgtttataagaaattgaaggaaaaaacagaccaatatgtagcaaggggtttggttagaacagaagaaagcaaggagaaaattggtggtgcagatgatgtttttgtcggggatataagagacgccgagagcttagctcctgctattgagggaattgacgcgcttgttattcttaccagtgctgtgccaaagatgaaacccggatttgatccaagcaaaggtgggaggcctgagttctattttgaagatggagcatttccagagcaggttgactggattggacagaagcatcagatagatgcagctaaagctgctggagtgaagcagattgttttggttggatccatgggtgggacaaatcttaatcatccattgaacagcattggcaatggcaatatactggtttggaagagaaaggctgagcagtatctagctgactctgggataccctacacaattataagagctggaggtttacaagataaagaagggggcttgcgtgagttaatcgtgagtaaggatgatgaacttcttcagactgaaacaagaactatcgctagggcagatgttgcagaagtctgtgtccaggcattgcagtttgaggaggcaaaattcaaggcatttgatctggcctcaaagcccgaggggactggagagccaacaaaagacttcaagagccttttctcccagattgttagccgattttga

SEQ ID NO: 854 - DNA, 756 bp, Papaver bracteatum
atggcgagtactgtgattgttactggtgctggtggtagaactggtcaaattgtttacaagaaactcaaagagaggacggatgagtttgtagcaagggggttagtaagaacagaagaaagcaaagagaaaattggaggagctgacgatgtttttgttgcggatattagagatgctgagagtattgtacctgcaattcaaggagctgatgctcttgttattcttactagtgctgtgcccaaaatgaaacccgggtttgatcctactaaaggtggaagacctgagttcttttttgaagatggagctaatcctgaacaggttgattggattgggcagaagaatcaaattgatgcagcaaaagcagcaggagtgaagcagatcgtcttggttgggtctatgggtggaacgaacctcaatcatcccttgaacagcattggaaacggaaacatattggtgtggaagaggaaggcggagcaatacctggccgactctggtataccatacacaattattagagctggaggcttacaagacaaagatgggggtgtgagagagcttgttgttggcaaagatgacgagcttctcgagactgacataaggactattgccagagccgatgttgcagaagtctgcattcaggcattgctgttggaagaggctaagtttaaagcattggatcttgcttcaaaaccagaaggaactggcgagccaacaaaagattttaagactctcttttctcaaatctctacacgattctga

SEQ ID NO: 855 - DNA, 816 bp, Papaver bracteatum
atggcagaatcaaatcaaaaaattacagttcttgtcactggagcttcaggcttaactggtgaaattgcattcaagaaactgaaagaaagatcagacaaattcgtggttcggggtttagtaagatcagaagcaagtaaacaaagactcggtggaggtgatgaaatttttctaggtgatgtgatggataagaaaagccttgaaactgctatgcaaggaattgatgccttgattatactaacaagtgctgtaccaaagatagtacctggatcatatcccggtgctgatggcaaaagagctgaagatgtatttggtgaatcatttgatttcaatggtccaatgcctgaattctattacgaagaaggacagtaccctgaacagattgattggattggacaaaagaatcagatcgatactgcgaaatcttgtggtgttaagcatattgttctggttggatcaatgggtggaactgaccctaataatttcttgaatcacatggctaatggaaacatacttgtttggaagagaaaggctgagcaatatttggctgattctggaatcccatacacaattataagggctggtggtttagataacaaggttggtggcagggagttgttggtcggaaaggatgatgagcttctctctactgaaaaccatttcattgctagggcagatgttgctgaagcttgcgttcaggctctgcagattgaggaaagtaaattcaaagcgtttgatttgggatcaatgcctgagggagttggcgagccaacaaaggattttaaggctctttttgccccaatcactactcgtttctga

SEQ ID NO: 856 - DNA, 810 bp, Papaver bracteatum
atggcagaatcacagcaaaaaatgaccgtccttgtcaccggagcttccggattaaccggtcaacttgcattcaagaaattgaaggagagatcagacaagtttgtagtgaggggcttggttagatcagaagcaagtaagcagaaacttggaggaggagatgagatttttattggggatattckaaatrcagagagccttgttcctgccatgacaggaattgatggtctcatcattctcacctctgctatcccaagaattgtacctggatccatgcctgatactgaaggtaaaaggkcygaagatgtartygayrgttcattcgaaggcccgatgcccgagttttattatgaagagggtcaatacccagaacaggttgattggattggacagaagaatcaaattgatacagctaaatctttgggagtcaagcatattgtgttgattggatcaatgggtggacaagaccctaatcatttcttgaactayatgggaaatggraacatyttgatttggaagagaaaggctgagcagtacctggctgactgtggagtcccatacacaattataagggctggaggcttagataacaaagaagggggtagacagttgttggtaggacagaatgatgagcttctccctactgaagatggatacattgccagggcagatgtcgctgaagcttgcattcaggctctgcagattgaggagtctaaattcaaagcattggatttggggtcgaagccagagggagttggtgagcccaccaaggatttcaagcatcttttcgcctcagtcactactcgtttctga

SEQ ID NO: 857 - DNA, 813 bp, Sanguinaria canadensis
atggcagattcacgtcaaaaattgaccgtccttgtcaccggagcttccggattaactggtcaaattgcgttcaagaaattgaaggagagatcggaccagtttgtggtgaggggtttggttagatcggaagcaagtaagcagaaacttggaggaggagatgagatttatattggggatgtaatgaatgccgaaagccttgttccagccatgacaggaattgatgctctcatcattctcaccagtgctatccccaaaattaaaccgagtgaatcctttcccgtcgttgagggtcaaaggtctgaagatgtagtcgacggttcattttcaggtccgatgcctgagttctattacgaagagggacaatacccagaacaggttgattggattgggcagaagaatcaaattgatacagctaaagctttgggagtgaagcatattgttctggttggatcagtgggtggaacagaccctaatcacttcttgaactccatgggaaacggaaacatactgatttggaagagaaaggctgagcagtatctggctgactctggaatcccatacacaattataagggctggaggcttagataacaaagaagggggtagggagttgattgttggaaaggatgatgagctactctccactgaaaatggatacattgctagggcagatgtcgcagaagcttgcgttcaggctctgcagattgaggaggcgaaatgcaaagcattggatttgatgtcaaagccagagggagttggtgagcccaccaaggatttcaagggtcttttcgccagtgtcactactcgtttctga

SEQ ID NO: 858 - DNA, 816 bp, Sanguinaria canadensis
atggcagattcacgtcaaaagtttaccgtccttgtcaccggagcttccggattaactggtcactttgcgttcaagaaattgaaggagagatcggaccagtttgtggtgaggggtttggttagatcggaagcaagtaagcagaaacttggaggaggagatcagatttatattggggatgtaatgaacgccgagagccttgttcccgccatgacaggaattgatgctctcatcattctcaccagtgctatccccaaaattaaagcagatgaatcatttccagtggctgagggacaaagggctgaggacgtaatagatgaaacattttcaggtccgatgcctgagttctattacgaagagggacaatacccagaacaggttgattggattgggcaaaagaaccaaattgatacagccaaagctttgggagtgaaacatgttgtactggttgcatcaatgggtggacaagaccctaatcacttcttgaactatatgggaaacggaaacatattgatttggaagagaaaggctgagcagtatctggctgactctggattaccctacaccataattagggctggaggtttagataacaaacaagggggaattagggaattattggttgataaggatgatgtgcttctccctactgcaaatggttacattgctagggctgatgttgctgaagcttgcgttcaggcgctgcattgtgaggaggtcaaattcaaggcatttgatttgggatcaaagccagagggaactggtacaccaacaaaggactttaaggctctgttcgcccccatcaccactagcttctga

SEQ ID NO: 859 - DNA, 849 bp, Sanguinaria canadensis
atggcttgcaagagttgttgcagcaaaataatggcctgttcaacccccaagaaaacagtccttgttacaggagcttccggcttaactggtcaatttgcgtttaacaaattgaaggagagatcagacaagtttgtggcgaggggtttggttagatccgaagggagtaagaagaaacttggaggaggggatgagatttatatcggggatgtaatggatcagaagagccttgaacctgccatgaaaggaattgatgctctcatcattcttaccagtgctatcccaaagatgaaacctggtcaattccccgaaggtggtggtggtggtggtagggctgaggatctaatcgatggatcatttgaaggtccaatgcctgagttctatttcgaagaaggacaatacccagaacgggttgattggatcggacagaagaatcaaattgatgcagctaaagctgctggagtgaagcatattgttttgatttcatctatgggttctggagaccctaatcaccctttgaacagtctaggaaatggaaatatactggcttggaagagaaagtctgaagagtatctggctaattctggagtaccatacactataataagggctggaggcttagataacaaagaaggtggaataagggagttgttggttgggaagaatgatgagcttctccctactgaaaaaggatacattgctagggcagatgttgcagaagcttgtgttcaggctgtgctgtttgaggaggtcaaattcaaagcattcgatctagggtcaatgccggagggaactggtaccccgacgaaggatttcaaggcgcttttcgccccaatcactactcatttctga

SEQ ID NO: 860 - DNA, 804 bp, Sanguinaria canadensis
atggatgattcacgtcgaaaaactgtccttgttaccggtgcttctggtgcaactggccaaattgcttataacaaactcaaggagagacctgatcagttcgttgcgagggggtttgttaggtcagaacacagtaagcagaaaatcggaggtggagatggtgtttttataggagacatattggatccagagagcattgctcctgctgtccaaggaattgatgctctcataattctcacaagtgctatcccaaaaataaaacctgggcaatttcctgacacaggtggaaaggctgagagttatattagtcaatcatttgaatcaatgcctgaattctatttcgaagaaggacaatacccagaacaggttgactggatagggcagaaaaatcaaatagatgcagctaaagctgctggagtgaagcatattgttttgcttgggtctatgggtgggacagacccaaatcaccccttgaacgtcttagggaatggaaatatactgatttggaagagaaagtcggagaagtatctggctgattctggattaccatacactataatgagagctggaggcctaattgacaatccaggaggtatgagagaacttcttgttgggaggaatgatgagcttcttccgactgaaaatggattcgtccctagggcagacgttgcagaagtctgtgttcaggcattgctgtttgaggaggccaaattcaaggcatttgatctggcctcaaagccagaggggaaaggtacaccaaccaaggatttcaaggctctattttcccaagtcactgatcgcttctga

SEQ ID NO: 861 - DNA, 816 bp, Sanguinaria canadensis
atggcacgtctacttcaaagcacagttcttgttactggcgctgccggtttaacaggacaaattgtttataagaaattgagggaaagagccacgcaatatatcccaaggggtttagtaagatccgaagaacgtaagaagaaaataggaggatcagatgatgttttcattggggatataacagatgccaaaagcatcattcctgctgtccaaggaattgatgccctaataattcttacaagtgctataccaaagatcaaacccggattcatcgtacccacaaaaggtgaaagggctgagaactacattggggaagatggatcatttgatgaaatgcctgagttctacttcaaagatggcgggtcccctgaacaggttgactggatagggcagaagaatcaaatagatgcagctaaaggagctggagtgaagcaaattgttttggttggatccatgtgtggaacaatccctaaccaccctttgaacaacctaggaaacgggaatatactggtttggaagagaaaagctgagcaatatctcgctgactccggagtaccatacacaataatcagggctggaggtttaggagacaaacccggtggtctgcgggagttgcttgtgggtaaggatgatgagctgcttcaacagcctgaattagtagacgtctccagggccgatgtcgctgaagtctgcattcaggcgctgcaatttgaggaggccaaattcaaggcattcgatttgggctcaaagcctgagggaactggtacaccgacaaacgatttcaaggcccttttttcccaagtcagcactactttctga

SEQ ID NO: 862 - DNA, 813 bp, Stylophorum diphyllum
atggcagattctgatcgaaaaacaatccttgttactggagctgctggttcaactggaaatcttgcttacaagaaattgaaagagagaacagagaagtatgtagcaaggggattggtaagatcagaagagagtaagaaaagaattggaggagcagatgatgtttttatagggaatataagggatgcccagaccttggttcctgcagttgaagggattgatggtcttataattcttacaagttctttgcttaagatcagaccaggatctgctgcaccaaaaggtgataaggctgagtattactttttggaagatggttcacttgatcctgacatgcctgagttttactatgaagaatctcctgaacaggttgattggattgggcagaagaatcaaattgatgcagctaaagctgctggggtgaagcatattgttttggttggatcaatgggtggaacagacccaaatcaccccttgaacattctaggagacaatggaaattttctgatttggaaaagaaaagctgagcagtatctggctgactctggaataccatacacaattataaggtgtggaggtcttgatgataaagaaggaggaaagagggaattacttgtgtcaaaagatgatgaaatgttttctcagattgaactgatatatatttcgagggaagatgttgcggaagtctgtattcaggcatttgagtgtgaggaggccaaattcaaggcgtttgatctgacatcaaagccagagggaactggtacaccaacaagggacttcaaggctcttttcgcacaagttactactcgtttctga

SEQ ID NO: 863 - DNA, 810 bp, Stylophorum diphyllum
atggctgaatcacagcaaaagatgaccgtccttgtcaccggagcttccggattaaccggtcagcttgcattcaagaaattgaaggagagatcagacaagtttgtagtgaggggtttggttagatcagaagcaagtaagcagaaacttggaggaggagatgagatttttattggggatattctaaatacagagagccttgttcctgccatgacaggaattgatggtctcatcattctcacctctgctatcccaagaattgtacctggatccatgcctgatactgaaggtaaaagggccgaagatgtagttgatggttcattcgaaggcccgatgcccgagttttattatgaagagggtcaatacccagaacaggttgattggattggacagaagaatcaaattgatacagctaaatctttgggagtcaagcatattgtgttgattggatcaatgggtggacaagaccctaatcatttcttgaactacatgggaaatggaaacatcttgatttggaagagaaaggctgagcagtacctggctgactgtggagtcccatacacaattataagggctggaggcttagataacaaagaagggggtagacagttgttggttggacagaatgatgaacttctccctactgaagatggatacatttccaggacagatgtcgctgaagcttgcattcaggctctgcagattgaggagtctaaattcaaagcattggatttggggtcaaagccagagggagttggggagccaaccaaggatttcaagcctctttttgcctccgtcactactcgtttctga

SEQ ID NO: 864 - DNA, 804 bp, Stylophorum diphyllum
atggatgattcacgtcggaaaactgtccttgttactggtgcttccggtgcaacaggtaaacttgcttacgacaaactgaaggaaagacctgatcagttcatcgcgaagggtttcgttaggtcggaaaacagtaggaagaaaattggaggtggagatggtgtttttattggagatgtacagaatgcggagagcattgttcctgctgtccaaggaattgatgctctcataattctcacaagtgctatcccaaaaataaaacctgggcttgttcccgacgaaggccaaaaggctgagaagtatatagattcatcatttgaatcaatgcctgagttctactacgatgaaggacaatacccagaacaggttgactggattgggcagaaaaatcaaatagatgcagctagagctgctggagtgaagcatattattttggtttcatccatgggttctggagaccctaatcaccccttgaacagcctagggaatgggaatatattgatctggaagagaaaggctgagcagtatctggctgattctggagtaccatacacaataataagagcgggaggtctaattgacaatccaggaggtatgcgagaactacttattgggaggaatgatgagcttcttccaactgaagatggatatgtccctagagcagacgttgcagaagtgtgtgttcaggcaacgcagtttgaggagaccaaattcaaggcttttgatctaggctcaaagccggaagggaaaggtacacccaccaaagatttcaaggctctcttttccaaactcactgatcgcttctga

SEQ ID NO: 865 - DNA, 816 bp, Stylophorum diphyllum
atggctaattctgatcggaaaacagtccttgttactggtgctagtggtgtaactggaaatcttgcttacaagaaattgatggagagaacagataagtatgtgggaaggggttttgtaagatcagaagcaagtaaggaaaaaattggtgggacagataatgtctttatagggaatataagtgatccacagaccttagttcctgcagtacaaggaattgatgctcttataattcttacaagttctatgcttaagatcaaaccaggatctgctgcaccaaaaggtgtcaagcctgatgattactttaatgaagatggttcatttgatcctgacatgcctgagttttactatgaagatggaaattctcctgaagaggttgattggattgggcagaaaaatcaaattgatgcagctaaagctgctggggtgaagcatattgttttggttggatctatgtgtggaacatacccaaatcacccagtgaacattcttggaaatggaaatatgctggtttggaagagaaagtctgagcagtatctagctgactctggaattccatacacaattataagggctggaggtttagatgataaagaaggaggcctgagggagatagttttctcaaaggatgatgaaatgtttgctgacatgaacatgatatatatctctagggatgatgttgcagaagtctgtattcaggcactagaatgtgaggatgccaaattcaaggcgtttgatctaacatcaaatccagagggaaccggtacaccaacaacaaacttgaaggctcttttctcacaagttactactcgtttctga

SEQ ID NO: 866 - DNA, 768 bp, Stylophorum diphyllum
atggctgaatccaaccgtagcaccgtccttgttaccggagccggtggcagaactggtcagttagtttacaagaagctcaaggagaggtcaagcgagtatattgctagaggtcttgttagaagtgaggagagcaaatccaaaattggtggagcaaatgacgttttcattggagatgtcacaaaacccgaaactcttgctcctgctattgaaggcatagatgctcttgtgattctcacaagtggagttcctaaaatgaaacctggtttcgatccaactaaaggcggaaggcccgaattctattttgaagatggacaataccctgaacaagttgactgggaaggacagaaaagccaaatagatgctgctaaagctgccggagtgaagcaaattgttctggtgggctccatgggtggaacaaatttaaaccatcctttgaacagcttaggaaacgggaatatactggtttggaagagaaaggctgaacagtatctagcagactccggtattccatacacaattatcagggcggggggtttgcaagacaaggaaggtggtatcagggaattgcttatcggaaaagatgacgagcttcttcaaactgaaaccaaaactgttgccagaccagatgtcgctgaagtttgtgttcaggcactgcaaattgaggaggctaaattcaaggcatttgatcttgcctccaaacctgagggaactggaacaccaacaaaagatttcaaggccttattttctcagatcacaactcggttttga

SEQ ID NO: 867 - DNA, 753 bp, Stylophorum diphyllum
atgactactattattgttactggtgctggtggtagaactggtcaaattgtttataagaaacttaaggagagaacagatcagtatgttgcaaggggtttagttagaactgaagaaagcaaggagaaaattggaggtgctgatgatgtttttgtaggggatataagggatgctgatagtatcgtccctgcgatccaaggggccgacgctcttgtgattctcactagtgctgtaccaaagatgaaacccggtttcgatcctactaaaggtggaaggccagagttttatttcgaagagggagcttatcctgarcaggttgactggattggacagaagaatcaaattgatgcagctaaagccgcgggggtgaagcagatcgttttggttggatctatgggtggaacaaaccctaatcatcccttgaatagcattggaaatgggaatatattggtttggaagagaaaggcagagcaatacctggctgactctggtataccatacactataataagagctggaggcttacaagacaaagaagggggtgtcagagagcttgttgtggggaaggatgatgagcttctcgagactgaaataagaaccatcgcaagggccgatgttgcagaagtctgcattcaggcattgcaaattgaggaggccaagtttaaagctctggacctggcttcaaagcctgagggaactggtgagccaacaaaagatttcaagtctctcttcccccaagtctctacccgtttctga

SEQ ID NO: 868 - DNA, 768 bp, Tinospora cordifolia
atggcggatcttcctcgaaccactgttctcgtcaccggagcgggcggcagaactggtcaaattgtatacaagaaactgaaggagagagcagatcaatatgttggaaggggtttggttagaacggaagaaagcaaggagaaaattgggggtgcagatgatgtttttgtgggggatatacgagatgctgaaagcattttacctgcaattcaaggaattgatgctctaatcattctcaccagtgctgtgccaaagatgaaacctggatttgatcctagtaaaggtggaagacccgagttttattttgaagaaggctcttatccagaacaggttgactggattgggcagaaaaatcaaatagaagcagctaaaaatgcaggagtgaagcagattgtattggttggctctatgggtgggacaaacccaaaccacccattgaacagcttaggaaatgggaacatattggtctggaagagaaaggctgaacagtatttagctgactctggtataccatacacaattataagggctggagggttacaagacaaagaaggtggtgtgagagaactacttgttggcaaggatgatgaacttcttcagcttgatacaagatcgatcgcgagggaagatgtcgcagaggtctgcattcaggcattacagtttgaagaggcaaaattcaaggcgtttgatctggcctcaaagccagagggagctggtgagccaaccaaagatttcaaggctctgttctccaaaatttctacccgtttttga

SEQ ID NO: 869 - DNA, 768 bp, Thalictrum flavum
atgtccgccaccgatcgaagcactgttcttgttactggtgctgctggtagaactggtcaaattgtctataagaaactaaaggaaagagtagatcaatatgtagcaagggggttggttagaacggaagagagcaaggaaaaaattggtggtgctgatgacgtttttcttggggatataagggatgctggaagcataactcctgctatacaaggtattgatgctcttgtaattcttacaagtggtgtgccaaagatgaagcctggatttgatccaagcaagggtgggaggcctgaattctattttgaagaaggagcttatccagagcaggttgactggattggacaaaagaatcaaatagatgcagctaaagaagctggagtgaagcagattgttttggttgggtccatgggcgggacgaatcttaatcatccactgaacagccttggcaacgggaatatattggtttggaagagaaaggctgagcagtatctagctgattctgggataccatatacaattataagagctggaggtttacaagataaagaagggggcttacgggaattaattgttggcaaagacgatgaacttcttcagactgaaaccagaagtatcacaagggcagatgttgcagaagtatgcattcaggctctgcagtttgaggaggcgaagttcaaggcattcgatctggcctcaaaaccagagggaactggagaaccaacaagggatttcaaggctctcttctcccaagttgctactcgtttttga

SEQ ID NO: 870 - DNA, 759 bp, Xanthoriza simplicissima
atggctccaagcactgttctcgtcactggagctggtggtagaactggccaacttgtttataagaaattgaaggaaagagttgatcaatatgtagcaagaggtttggttagaacggaagaaagcaaggagaaaatcgggggtgctgatgatgtatttgttggggatataagggatactgcgagcatagctcctgctattcaaggaattgatgctcttgtaattctcaccagtgctgtgcccaagatgaaacctggatttgatccaagcaaaggtgggaggcctgaatttttttttgaagatggagcttatcctgagcaggttgactggattggacagaagaatcaaatagattcagctaaagcagcgggagtaaaacagattgttttggttggatctatgggtgggactaatcctaatcatcctttgaacagccttggtaacgcgaatatactggtttggaagaggaaggcagagcaatatctagctgactctggcataccatacacgattataagggcaggaggtttacaagataaagaagggggcttacgggaattgattgttggcaaggatgatgaacttcttcagactgaaacaagaggtatccctagggcagaagttgctgaagtatgcattcaggctttgcagtttgaggaggcaaaattcaaggcattggatttggcttcaaagcctgagggtactggggagccaaccaaagatttcaaggctctcttctcccaagttactacccgtttttaa

SEQ ID NO: 871 - protein, 325 aa, Argemone mexicana
MEEVIGLETVVPKVTLSSSSGDNSMPVIGFGTAASPMADHEITKAAVLVGIENGYRHFDTAAAYGTEKAVGEAIAEALRLGLIKSRAEVFITTKLWCRSCERDLVVPSLKNSLQDLQTDYVDLFLIHWPVRLRHDAGRPPISRDQILTFDTKSVWEGMEECHELGLAKNIGVSNFSIKKLEELLATAKIPPVLDQVELSPTWHQKNLIEYCKEKGIHVTAYSALGANNTHWGNNRVVESDVLGEIAKARGKTTAQIALRWVYEQGVSMVVKSFNQERMKQNLQIFDFELTEEESNKISQFPQHKGVSLSAVYGDHDILKEMEAEL

SEQ ID NO: 872 - protein, 322 aa, Argemone mexicana
MENVIPRVTLSSGSVMPILGMGTASYPFVSSEEGKLAILNAIKVGYRHFDTASTYMFEEFLGEAIAEAIQLGLIKSRKELFITSKLWCCDAHPDLVVPSLRNSLRNLKLEYLDLYLIHFPVSLKAGRYEYPPLKEALVLMDYKSVWAAMEECQNLGLTKSIGVSNFSCKKLQTILDYAKIPPSVNQVEMNPVWQQKKLREFCKANDIVITAYSPLGASGTPWGSSRVLDAQVLHEIARAKGKTHAQVCLRWVYEQGVSLLVKTFNEERMKENLRIFDWELTEEDKQKISKIPQHRGLTGDAFVSEHEGAPFKTAEELWDGEV

SEQ ID NO: 873 - protein, 322 aa, Argemone mexicana
MDMNKHAVVYVPTKVIMGIPVIGFGTSADPPVDFDTTRLAIMQAIENGYRHFDTAALYNSEQPLGEAINEAISRGLIKSRDELFITSKLWCSDTHPQHILPAIQKTLRNLNMEYLDLYLIHWPVSSRHENFEYPIKKEDFLPMDFKKVWAAMEECHKQGLAKFIGVSNFSCKKLDNIMASATISPSVLQVEVNPCWQQKRLIDFCKANGIFVVAYAPLGAVGTIYGTNRVMESDVLKQIAKKRGKSVAQVCLRWAYEQGIGVVVKSFNKERMKQNLEIFDWKLSEEDTKKISEIQQDRACLGMDYTSPYGPYKTIKQLWDEE

SEQ ID NO: 874 - protein, 322 aa, Berberis thunbergii
MEIVPKVTLNSGYQMPLLGFGTAENWPFTKSEAAKRAILCAIKNGYRHFDTASMYQSEESLGEAIVEALHLGLIKSRNELFITSKLWCSDCHQDRVLPALRETLKNLHLDYLDLYLIHWPLSAKPGKHEYPILKDKLLPMDYESVWGAMEECQRLGLSKSIGVSNFSSKKLEQLLKTAKIIPAVNEVEVNPVWHQNKLIEFCKAKGIVVTGYSPLGAKGTTWGTNKVMDSEVLKEIAKTRGKTHAQVCLRWIYEQGVGLVAKSFNEERMKENLEIFDWALTEEESKQISQLPQYKGQNGETFLSAEGPFKTLEELWDEEVAA

SEQ ID NO: 875 - protein, 320 aa, Berberis thunbergii
MEIVPKVTLNSGYQMPLLGFGTAENWPFTKSEAAKRAILCAIKNGYRHFDTASMYQSEESLGEAIVEALHLGLIKSRNELFITSKLWCSDCHQDRVLPALKNTLQNLQLDYLDLYLIHFPLSSKRGKLEYPLQEDETYPMDFGSVWEEMEKCQRVGLTKSIGVSNFSAKKIEHLLTTAKIIPAVDQVEMNPLWQQRTLREYCKTKGIVVTAYSPLGAKGAIWGSNIVMENEVLAEIAKAKGKTHAQVCLRSVYEKGVALVTRSYNEERMKQNLNIFDWNLSKEETKRIDNLPQKRVFLGEGFLSPLGPFKSPEELWDGEM

SEQ ID NO: 876 - protein, 324 aa, Corydalis chelanthifolia
MMVSVPEVTLQSSSSDKKMPIMGMGTAAYPFAESDEAKAALLTSIKLGYRHFDTASLYHNEKSVGKAISEALKLGLVKSRDEFYINSKLWCSDSHPDRVIPALQESLKKLGLEYLDMYLIHWPLSLKKGSYEFPIPTDEEILPMDFKAVWAAMEECQKLGLTKSIGVSNFSCKKLETILSTAKIPPVVNQVELNTLWQQTKLNKFCKDNGIVLMAFSPLGAHGSPWGTNRVMECELLHEIAKAKGKTLAQVCLRWIYEQGAGILVKSYNEVRMKENLEIFDWELSAEELKSISELPQHRGFPADSLLSAKGPFRTEEELWDGEI

SEQ ID NO: 877 - protein, 339 aa, Corydalis chelanthifolia
MESVACEPGVIEQQQYFIPEVTCGGGSSTTRMRMPVVGMGTASYPFAGSEGVKQALLHAIKLGYWHFDTASFYQTEQSLGEAISEAIQLGLIKSRDELFITSKLWCTDAHKDLVLPALQNTLRNLQLEYLDLYLIHFPISLKPGRYDFPVQSKEDLLPMDFKSIWAKMEECQGLGLTKSIGVSNFSCKKLENLLATAKIPPAVNQVEMNPLWQQKKLREFCKANGITITAHSPLGAKGTNWGTNRVVECEVLHQIAKAKGKSHAQVCLRWVYEQGVSLLVKSFNKERMKENLGIFDWELNAEDLKKISEIPQGRGLPVDGFLSPNGPFKSEEEFWDGEI

SEQ ID NO: 878 - protein, 301 aa, Corydalis chelanthifolia
MPVVGFGTAKFPFGDDEAIKLAVLEGIKLGYRHFDTATKYKSEKPLGETIVEAINLGLIKSRDELFITSKLWCGSTERSLIVPSLKTSLQNLQLDYLDLYLIHWPLRFSTDETPTPVPKEQLLPFDTKSVWQAMEECQNLGLTKSIGVSNFSCKKLEELLSTAKITPAVNQVELNTSWQQTKMREFCKGKGIHITGYSPLGSYGTKWGDNRVVENQVLEEIGKPRGKTAVQVCLRWIYEQGASMVVKSFNKERMKANLDIFDWKLTEEELKRISQLPQHKASLPTASFGDHDEVRELDYEI

SEQ ID NO: 879 - protein, 327 aa, Chelidonium majus
MESDSAAAAVVVPVTTLSSGIEMPMLGMGTVENFLPGSETVKLALLNAIKLGYRHFDTAAIYQTEECLGEAVAEALQLGLIKSRDQLFITSKLWCSDAHPDLVIPALQNSLRKLKLEYLDLYLVHWPLSSKPGNCVFPILKEDLLPLDFKSVWAAMEECQKLGLTKSIGVSNFSCKKLQDLLTSAIIPPVVNQVEMNPRWQQKKLREFCKARDIVVTAYSPLGAKGTVYGSGAVMDCEVLHQIAKIRGKSVAQVSLRWVYQQGVTPLVKSFNEERMKENMKIFDWELYEEDLKMIDEIPQSRVNPCYFFLSENGPFKTVEEFWDGEV

SEQ ID NO: 880 - protein, 327 aa, Chelidonium majus
MESSNNAVLVPVITLNSGREMPIVGMGTAENLFQGSERVKLALLTAIKVGYRHFDTAAVYQTEESLGEAIAEALQLGLIKSRDELFITSKLWLPDCHHDLVLPALQNSLRKLKLEYLDLYLIHWPVSSKPGEIKHVIPKEELLPMDFKSVWAAMEECHKLGLAKSIGVSNFSCKKLQDLLVTANIPPDVNQVEMNPLWQQTKLREFCKAHGILVAAYSPLGAKGTAWGRTNGVMDSEVLQQIAKARGKSIAQVSLRWVYEQGVVLLVKSFNEERMKENLKIFDWELSGEDLKKISEILPQRRGLPSHVFVSDDGPFKSEEELWDGEV

SEQ ID NO: 881 - protein, 327 aa, Chelidonium majus
MESSNNAVLVPVITLNSGREMPIVGMGTAENLFQGSERVKLALLTAIKVGYRHFDTAAVYQTEESLGEAIAEALQLGLIKSRDELFVTSKLWIPDCHHDLVLPALQNSLRKLKLEYLDLYLIHWPVSSKPGELRSLIPKEELLPMDFKSVWVAMEECHKLGLTKSIGVSNFSCKKLRDLLLTANIPPAVNQVEMNPLWQQKKLREFCKANGIVIAAYSPLGAKGTAWGRTNDGVMDSELLQKIAKARGKSTAQVSLRWGYEQGVILLVKSFNEERMKENLKTFDWELSGEDLKQINEILPQRRGHSHEFISDNGPFKSEEELWDGEV

SEQ ID NO: 882 - protein, 328 aa, Chelidonium majus
MGEEMIKTSSVEIPVATLSTGRTMPLLGMGTAAYPFVGSDGVVKAILHAIKLGYRHFDTAALYFTEECLGDAVAEALRLGLIKSRDELFITSKLYCCDAHPDRVVPALQNSLRKLKMEYLDLYLIHWPASTHEGNFEFPLQKQDILPLDFKSVWAAMEECQKLGLTKSIGVSNFSCKKLQDLLASAKIPPAVNQVEMNPIWQQNKLREFCKANDIHITAYSPLGANGTPWGSSGVAETQVLHDIAKARGKTHAQVCLRWVYEQGVSVLVKSYNEERMKENLAVLDWELSEENLKKISEIPQRRGLPGDIFVSDNGPFKTVEELWDGEV

SEQ ID NO: 883 - protein, 306 aa, Cocculus trilobus
MPVVGMGLAAYPFQESEVVKLAMLRAIEMGYRHFDTAALYQTEQSLGLAIAEALELGLIKSRDELFITSKLWCSDAHPHLVIPALQRTLKNLGLDYVDLYLIHWPVSSNKPGKYDFPVPKEELVQMDYESVWAAMEEGHRLGLTKSIGVSNFSCKKLENLLTIAKVPPTVNQVEMNPFWRQYKLKEFCKEKGIIITAYSPLGAKGTIWGTNKVMESKVLEDIGIASGKTLAQVCLRWVYEQGVTLLVKSFNEERMKGNLDIFDWELSEKELKKINEIPQSRGLPGDIFVSDDGPFKSEAELWDGEV

SEQ ID NO: 884 - protein, 321 aa, Eschscholzia californica
MGSCSIPVKSLSSGREMPVIGMGTADSNLAGSDASRIALVKAIEVGYRHFDTASIYQSEQNLGDAIAQALELGLIKSRDELFITSKLWSSDSHPDRVVPALQESLRKLKLEYLDLYLIHWPASSTPGIYEFPIPKDEIFPLEYETIWAAMEECQRLGLTKSIGVSNFSSKKLQTILNTATIPPAANQVEMNPVWQQKKLKEFCDANNILLTAYSPLGAKGTSWGSNKVMESEVLKQIAMANGKSVAQVSLRWLYQIGATMVVKSYNAERMKENLKIFDWELSDEDMKAISEIPQRRNFAGDILISSNGPFKSEDELWDGEV

SEQ ID NO: 885 - protein, 323 aa, Eschscholzia californica
MSSYGSVPMKSLNSGSKIHVLGFGTAAYPFVGSDGVKNAILNAIKLGYRHFDTAALYFTEESLGEAVSEALQLGLIKSRDELFITSKLWISDAYPDRVLPAIQKTLRNLKMEYLDLYLIHWPISGKEGNFDLPVPKDCLQELDYKPVWAAMEECQKLGLTKSIGVSNFSCKKLQIILSSATIPPAVNQVEMNPIWHQKKLREFCKANNIMIAAYSPLGAAGTPWGSSGVVETEVLHEIARSRGKTHAQVCLRWVYEQGVIVLVKSFNEERMKENLSVFDWELTDEDLKKISQIPQRRGLPSGDIWVSTEGPFRSEEELWDGEI

SEQ ID NO: 886 - protein, 324 aa, Glaucium flavum
MEMSSAQVVPLMTLNSGKEIPVLGMGTAENHFQGSDGTKDALVNAIKIGYRHFDTAAIYNVEECLGDAIAEALQHGLIKSRDELFITSKLWISDSHPDRVLFALQNSLRKLKLEYLDLYLIHWPLSSTPGKSVFPVPKEDFLPLDFKSVWAAMEECQKLGLTKSIGVSNFSCKKLQDLLDIANIPPAVNQVEMSPLWQQKKLREFCKVNGILVTAYSPLGAKGTFWGSNEIMDSHVLQEIAKARGKSVAQVTLRWVYEQGVILLVKSFNENRMKENMAIFDWDLSIDDLKKFDEISQRRGNLGDFFVSENGPFKSVDMVWDGEV

SEQ ID NO: 887 - protein, 326 aa, Glaucium flavum
MESSSSSAVVVPVMTLNSGKEMPVLGMGTAENNLQGSEKTKLALLTAIKAGYRHFDTASAYNTEEALGEAVAEALQLGLIKSRDELFITSKLWCSDAHPGLVVPALQNSLRNLKLEYLDLYLIHWPVSLKPGKFVIPFSKEDILPLDFKNVWAAMEECQKLGLAKSIGVSNFSCKKLQDLLAIANIPPAVNQVEMSPLWQQKKLREFCKVNGILVTAYSPLGAKGTFWGSNEIMDSDVLNQIAKARGKSVAQVSLRWVHEQGVILLVKSFNENRMKENMAIFDWELSNDDLKKMDEISQRRGPLADIFVSENGPFKSVDMLWDGGF

SEQ ID NO: 888 - protein, 326 aa, Glaucium flavum
MGSSDAVVVPVKTLSSGRKMPVIGMGTAEILLVDGSEKVKLALLNAIKIGYRHFDTAAVYRTEEALGEVVAEAIQLGLIKSRDELFITSKLWLSDSHPDLVLPALQNSLRKLKFEYLDLYLIHWPLSSKPGELKVLIPKEELLPLDFKSVWAAMEECQKLGLTKSIGVSNFSCKKLQDLLDIANIPPAVNQVEMNPLWQQKKLNEFCKANDIVITAYSPLGAKGTPWGSNRVMDSEVLNQIAKARGKSVAQVALRWVYEQGVSLVVKSFNEERMKENVTKIFDWELSAEDLKKIEEIPQCRGVPSHVFVSVNGPFKSEEELWDGEI

SEQ ID NO: 889 - protein, 327 aa, Glaucium flavum
MGEEMKIKSVEIPVVTLSSGRTMPVFGMGTAAFPFVGSDGVVKAITHAIKLGYRHFDTAALYFTEESLGDAIAEALRLGLIKSRDELFITSKLWCCDAHPDRVLPALRNSLRNLKIEYLDLYLIHWPASTHEGNLEFPIQKQDIHPLDYNSVWAAMEECQTLGLTKSIGVSNFSCKKLQHILAIAKIPPAVNQVEMNPIWQQKKLREFCKANDIHITAYSPLGANGTPWGSSGVVETQVLHDIAKARGKTHAQVCLRWVYEQGVIVLVKSYNEERMKENLTVFDWELSAEDSMKISEIPQHRGLPGDIFVSDSGPFKSEEELWDGEV

SEQ ID NO: 890 - protein, 319 aa, Hydrastis canadensis
MGSVPNVILSSGHPMPLVGFGTAGFPFGTSEGIKSAILCGIKNGYRHFDTASVYQTEQILGEAIAEALELGLIKSRDELFLTSKLWCSDAHQQHVLPALQKTLRTLQLDYLDLYLVHWPLSSKPGKYEYPIPKEELLPMDFKSVWAAMEECQALGLTKSIGVSNFSCKKLEQLLSTSNIPPAVNQVEVNPIWQQNKLREFCKAKGIIVAAFSPLGAKGTSWGTNKVMDSEVLNEIAQARGKTTAQNCLRWLHEQGVCVVVKSFNEERMKGNLKLFDWELSKEESKKISQLPQSKGHTGDDMVSANGPFKSLEELWDGEI

SEQ ID NO: 891 - protein, 319 aa, Hydrastis canadensis
MTRIPEIVLNSGWRMPVLGMGTATFPIQSPEVIESSIVNAIELGYRHFDTASVYQSESPLGRAISEAIRRGLIESRKEVFITSKLWCTDAHHDLVIPALHKTLQNLGLEYLDLYLIHFPVRLKGDISFDIKKADLIPFDVKGTWEAMEKCQELGLTRSIGVSNFSSKKLSELLTHATISPAVNQVEMHPFWQQKELRAFCADKGIHVSAYSPLGGKGALWGSDILLNSKEIERIAQAKGKSIAQVCLRWAYEQGVSYLPKSYNKGRMKENMEIFDWQLSEDELQKISHLPQGKIYTGHHFISDDGEYKSPIDLWDCEIC

SEQ ID NO: 892 - protein, 320 aa, Hydrastis canadensis
MGIVREVVLNSGERMPLLGMGTATYPVAPFELVESSVIAAIELGYRHFDTASVYETEQPLGLAISEAVRQGLIASRDEIFITTKLWCGHAHYDLVLPALRDSLETMGLDYVDLYLIHFPARFNMKEKSLNVNKKDLLPLDIRGTWKAMEECYELGLAKSIGVSNFSCKKLSQLLSVANIPPAVNQVEMHPLWQQQKLREFCEEKGIHVSAYSPLGGKGTIWGSNAVLDSDQIKQIAKAKGKSIAQICLRWGFEHGVSILPKSFNKERLKENMEIFDWELSKEELQKMNTFPQNRIFQAEHLVSPDEGLFKSVADLWDGEI

SEQ ID NO: 893 - protein, 328 aa, Jeffersonia diphylla
MCFCVLVTKRAMGIVPEVTLNSGHQMPLVGFGTAQFPFPEGDEAKQIIAPILCGIKSGYRHFDTASLYKTEEALGEAIKEALRLGLIKSRDELFITSKLWCTDSHQDLVLPALKKTLQNLQMDYLDLYLVHFPVSSKPGKPEFPPQKEDLLPMDFGSVWAAMEECQRLGLTKSIGVSNFSCKKLEQLLTTAKIIPAVNEVEMSPVCQQNKLREFCKVKNIVVTAYSPLGGGSNAVKDNKVLKEIAKAKGKTCAQVTLRWVYEQGVALVPKSFNEGRMKENLDIFNWTISEEEFKQISQLPQGRVATGEWFVSVEGPFKSLEELWDEVI

SEQ ID NO: 894 - protein, 321 aa, Mahonia aquifolium
MGVVPVVTLNSGHEMPLVGFGTAVPAFGGSDAIKQAILCGIKNGYRHFDTASVYQTEKSLGEAIVEALRLGLIKSRDELFITSKLWCTDAHQDGVLPALRETLKNLQLDYLDLYLIHWPLSAKPGKHEYQIPKDELLPMDYESVWGAMEECQRLDLSKSIGVSNFSIKKLEELLKTAKIIPAVNEVEVNPVWHQNKLIEFCKAKGIVVTGYSPLGAKGTTWGTNRVMDNEVLKEIAKTRGKTHAQVCLRWIYEQGVGLVAKSFNEERMKENLEIFDWALTEEESKQISQLPQYKGQNGETFLSAEGPFKTLEELWDEEIAA

SEQ ID NO: 895 - protein, 320 aa, Menispermum canadense
MASVPEVTLSSGHPMPLFGFGTAAWPFVSSEGAKSAILCGMELGYRHFDTASIYGTESSLGEAIAEALKLGIIKSRDELFITSKLWCCDGHHDRVLPALQMTLKNLQLDYIDLYLEHWPLSSVPKGELEYPIPKEKLFPMDLKAVWEAMEECQRLGLTKSIGVSNFSCKKLEDLLAFAKIPPAVNEVEMNPVWQQKKLRDFCKAKGIVLTAYSVLGAKGTLWGTNKVMDSEVLGKIAKARGKTVGQVCLRWAYEQGACVLVKSFNEERMKENLETFNWELGEEDLKMISEIPQYKGLRGEDMVAPNGPYKTLEELWDGEI

SEQ ID NO: 896 - protein, 341 aa, Menispermum canadense
MGVDKTNEFSNGNAASPVLIKEANLFKIAEVTLNSGHHMPVLGTGTASFPFPPLKELKKAIVEAMEVGYRHFDSAALYQSEEGLGAAIAEALEKGLVKKREELFITTKLWCNNAHSDRVLPAIRESLRKLRLDYVDLYLIHFPVRLKEDLLDMNCKKGGIFELDLKSVWAAMEQIQHLGLAKSIGVSNFTCKKLTDLLSYAKIPPAVNQVEMHPVWQQKKLRDFCKEKGIHVSAYSPLGAKQWGFDVVLGNKILKEIAQDKGKTIAQIALRWGYEQGVILIPKSFNKGRLTENLRIFDWKLTEDELKKISSIQQSRVAIMPEFVFPESPFKTFEDFWDGEM

SEQ ID NO: 897 - protein, 322 aa, Menispermum canadense
MEGGGVPKILLNSGHRMPVLGMGTASFPISPQHLVKSSILTAIELGYTHFDTASVYETEPTLSRAIRQALEGRHIASRDQLFITTKLWCGQAQSDLVVPALRESLQELGLDYVDLYLIHFPARFKCVEKTFNVTKEDLLPLDMKGTWQAMEECCKLGLAKSIGVSNFSCKKLSQILTFATIPPAVNQVEMHPLWQQRKLREFCKEKGIHVSAYSPLGGKGAKWGSNAVFECEEIKQIAEAKGKSLAQICLRWAFEQGVSFVPKSFNKERLKENMEIYGWELSKEELQKLSVLPQCRIFKGEWLVSADHGVFKSVEDLWDGEI

SEQ ID NO: 898 - protein, 319 aa, Nandina domestica
MVSVPEVTLNSGHRMPLVGMGTACFPLPGSEVVKSAMVTAIKLGYRHFDTAALYQSEQPLGEAIAEALHLGLIISRDELFITSKLWCTDAHQDLVLPALKTSLRNLQLDYLDLYLIHFPVSLKPGKIQLPVPKEELLPMDFKSVWAAMEECQKLGLTKSIGVSNFSCKKLEHILSLAKIPPAVNQVELNPIWRQKKLIEFCKAKGIVVTAYSPLGAVAPGQGSNRVMECEVLSEIAKARGKTHAQVCLRWIIEQGVSLVVKSFNEDRKKKNLEIFDWELSEEDSKKISQIPETRGNPGDFVISVDGPYKSREELWDGEI

SEQ ID NO: 899 - protein, 319 aa, Nandina domestica
MGRVPETTLSSGHNMPLLGMGTATFPLPPSELIESYILAAIEMGYRHFDTASVYDTEVPLGRAISEALRRGLVANRDELFITTKLWCGHAHPDLVVPALHQSLMEMGLEYVDLYLIHFPARFNKKEKNFDVKKEEVIPLDMKGTWEAMEECSKLGLAKSIGVSNFSCKKLSQLLTYATIPPAVNQVEMHPLWQQWKLREFCVANDIHVTAYSPLGGKGALWGSNSVLDSKEIQQMAEAKGKSIAQICLRWAFEQGVSFIPKSFNVERLKENMEIFDWEMNKNELLKMSLLPQKRTFTAEYLVSPDGAFKSVDDLWDGEI

SEQ ID NO: 900 - protein, 319 aa, Nigella sativa
MARVPEITLNSGHRMPLLGMGTAVVPFKEPEPVKSAILTAIKNGYRHFDTASLYRTEPALGDAIAEALQLGLINSRDDLFITSKLWCTDNHPDLVLPALHTTLRNLKLDYLDLYLIHWPVSMTPGRIRFPGPDEKILPMDYKSVWAAMEECQKLGLTKSIGVSNFTCKKLELLLASATIPPAVNQVEVNPMWQQEKLIEFCRTKGIVVTAYAPLGTVGTFIGNNDIMNCELLKEIAQAKGKTNGQICLRWVHEQGVGLLVKSFTEVRMKQNLEIFDWELSEEESMKIKQLPQRKSHQGKGFVTADGPFKSLTELWDGEM

SEQ ID NO: 901 - protein, 317 aa, Nigella sativa
MVYEIMLNSGYRIPLLGMGTAAYPVPPPELVESSVLAAIELGYRHFDTAHIYGTEAPLGRAISEALRKGLIKSRDELFITTKLWPGHARPDLVLQALHQSLEALRIDYVDLFLIHFPARYNTTEIRMDIKKEDILPLDIKGTWQAMEECCKLGLAKSIGVSNFGCKKLSQLLDSATIPPAVNQVEMHPLWQQAKLREFCAERGIHVSAYSPLGGKGTLWGSNAVLDSEQIKQIALAKGKSVAQICLRWGFQQGVSIIAKSFNRERLKENMEIFDWELNKEELYKLSILPQNRISTLEYLVSPDAVFKSINDLWDEEV

SEQ ID NO: 902 - protein, 318 aa, Nigella sativa
MDNSVVVLNSGHRMPLLGMGTAATPLPPNEVVQSSVLAAIELGYRHFDTASVYGSEVILGRAISEALRRGLVASRDELFITTKLWCGNGHPDLVLGALQESLRIMELDYVDLYLIHFPVRFNITEKLLNMKNVPLLPFDMEGTWQAMEECCRLGLAKSIGVSNFSCKRLSELLLSASIPPAVNQVEMHPLWQQRNMREFCRKEGIHVSAYSPLGGKGAAWGSNAVLDSEDIQQIAQHKEKSVAQVCLRWAFEQGVSIIVKSFNKERLKENTQIFDWELNKQELQRINTLPQNKIFKASNLISADGPYKTFEELWDGEV

SEQ ID NO: 903 - protein, 321 aa, Papaver bracteatum
MESNGVPMITLSSGIRMPALGMGTVETMEKGTEREKLAFLKAIEVGYRHFDAAAAYQTEECLGEAIAEALQLGLIKSREELFITSKLWCTDAHADLVLPALQNSLRNLKLEYLDLYLIHFPVSLKPGKIVSDIPKDQMLPMDYKSVWAAMEECQTLGFTRAIGVSNFSCKKLQELMATANSPPVVNEVEMSPIFQQKKLRAYCKANNIMITAYSVLGARGAAWGSNAVMDSKVLHEIAVSRGKSVAQVSMRWVYQQGACLVVKSFNEERMKENLKIFDWELSAEDMEKISEIPQSRTSSADFLLSPTGPFKTEEEFWDEKD

SEQ ID NO: 904 - protein, 321 aa, Papaver bracteatum
MEINGVPVISLSSGVRMPALGMGTAETMEKGTDRERSAFLKAIEVGYRHFDTAAAYQTEECLGEAIAEALQLGLIKSRDELFITSKLWCTDAHADLVLPALQNSLRNLKLEYLDLYLIHAPVSLKPGKILNEIPKDQMLPMDYKSVWAAMEECQTLGFTRAIGVSNFSCKKLQELMATANSPPVVNEVEMSPTLHQKNLREYCKANNIMIIAYSVLGARGTGWGSNAVMDSKVLHQIAVARGKSVAQVSMRWVYQQGACLVVKSFNEERMKENLKIFDWELTEEDMDKISEIPQSRTLSADFLLSPTGPFKTEEEFWDEMV

SEQ ID NO: 905 - protein, 323 aa, Papaver bracteatum
MRNTGVPVITLSSGKGIPVLGMGTFETVGKGGERERLAFLKAIEVGYRHFDTAACYQTEECLGEAIEEALQLGLIKSRDELFITSKLWCTDAHPDRVLLALQNSLRNLKLEYLDLYLIHFPVSLKPGNEVTMDAAGGEIFLMDYKSVWAAMEECQNLGFTKSIGVSNFSCKKLQELLATANIPPVVNQVEMSPVFHQKNLREYCKANNILVAAYSILGGKGTAWGSNSVLGSEGLNQIAIARGKSIAQVSMRWVYEQGAILVVKSFSEKNMRENLNIFDWELTKEDLERIGEIPQRRLIIQEFMVSSNGPFKSLEEFWDEKAD

SEQ ID NO: 906 - protein, 321 aa, Papaver bracteatum
MENVIPAVTLSSGSVMPILGMGTAAYPLVEPEEAKLAFLNAIKIGYRHFDTAASYHCEGFLGEAIAEALQLGLIKSRDELFITSKLWPCDAHPDLVIPAIQNSLRNLKLEYLDLYLIHFPISTKPAAGLVFPPPKDALLPMDYKSVWAAMEECQKLGLTKSIGVSNFSCKKLQTILDIANIPPAVNQVEMNPVWQNLKLRDFCKANNIVLTAYSPLGARGTPWGSNAVYEERVLHEIAEAKGKTHAQVCLRWVYEQGVSLIVKSFNELRMKENMMIFDWELTEDELQKIGKIPQRRGLPGDFFVSEAAPFKTVEEFWDGEI

SEQ ID NO: 907 - protein, 322 aa, Papaver bracteatum
MEVVIPKVALSSGRVMPVLGMGTSSFPPVGPEDGKAAILNAIKIGYRHFDTASVYKSEDFLGEAIAEALLLGLIQSRDQLFITSKLYCNDAHPDLVVPALQNSLRNLRLEYLDLYLIHFPVSSKPVKYEYHLKKEHLLPMDYESVWAAMEKCQKLGLTKSIGVSNFSCKKLQTILDTANISPAVNQVEMNPVWQNLKLRDFCKAKGIVVTAYSPLGASGTPWGSNAVKEAQELHEIAKARGKTHAQVCLRWVYEQGVSLLVKSFKEERMKENLMIFDWELTKDDLFKISKITQRRGLPGYRFISKLEGSPFKTVEEFWDGEV

SEQ ID NO: 908 - protein, 321 aa, Papaver bracteatum
MESSGVPVITLRSGKVMPVLGMGTFEKAGKGSERERLAILKAIEVGYRYFDTAAAYETEEVLGEAIAEALQLGLIKSRDELFISSMLWCTDAHPDRVLLALQNSLRNLKLEYVDLYMLPFPASLKPGKITMDIPEEDICPMDYRSVWSAMEECQNLGLTKSIGVSNFSCKKLEELMATANIPPAVNQVEMSPAFQQKKLREYCNANNILVSAVSILGSNGTPWGSNAVLGSEVLKKIAMAKGKSVAQVSMRWVYEQGASLVVKSFSEERLRENLNIFDWQLTKEDNEKIGEIPQCRILSAYFLVSPKGPFKSQEELWDDKA

SEQ ID NO: 909 - protein, 323 aa, Papaver bracteatum
MGSSCIPVLTLNSGNKMPVLGMGTFETFAKGGERERLAYLKAIKVGYRYFDTGAAYGTEEVLGQAIAEALQLGLIKSRDELFISTMIWATDAHPDGVLPAVQRSLRNLKLDYVDLYLIPFPASLNPEGEIPNYIPENETFLKMDYKSVWAAMEECQTLGFTKSIGVSNFSCKKLQEVMETANIPPAVNMVEMNPTFQQKYLREYCKANNILVNAYSVLGSTGTSWGSNAVMGSEVLKQIATDIGKSIAQVSMRWVYEQGAGFVVKSFSEERMRENLNIFDWELTKEDLEKISQIPQCRVLPMDFLVSSDGAFKSLEDLWDGEA

SEQ ID NO: 910 - protein, 303 aa, Papaver bracteatum
MPILGFGTAENLFEGGDKVKLAILKAIEVGYRYIDTAAVYRTEESVGEAVAEALQLGLIKSRDELFITSKLWGVDAHPDLVLPALQNSLRKLKLEYLDLYLIHYPVSLKPGEMVDDIPKDEIFPLDYKSVWAAMEECQKLGYTKSIGVSNFSCKKLQQLMATANIPPAVNQVEMNPTWQQKNLREYCKANNIFITAYSTLGAKDLLWGSNAVLGSKVLNQIAVARGKSVAQVSLRWVYEQGVSLVVKSFNEERMKENLKIFDWELTTEDLKMISEIPQRRVATADFFVSDIGPFKSLEELWDE

SEQ ID NO: 911 - protein, 306 aa, Papaver bracteatum
MPVLGLGTAENLTKGSEREMLAILKAIEVGYRHFDTAFIYQTQECVGEAIAEALQLGIIKSRDELFITSKLWGSDAHPDCVLLALQNSLRNLKLQYLDLYLIHYPVSLKPGTTLKDLGNKDNFLPMDYKSVWAAMEECQKLGLTKSIGVSNFSSKKIQELMSTDSIPPAVNQVEMNPTWQQKKLREYCQANNILVTAYSPLGAKGTTWGSNAVMGSEVLNQIALARGKSVAQISLRWVYEQGVSLVVKSFNEERMRENLKIFDWELTAEDLKKIDELPQSRVATAEFVVSENGPFKSLEEFWDDES

SEQ ID NO: 912 - protein, 321 aa, Papaver bracteatum
MENAIPAVTLNSGSVMPVLGMGTAAYPFVESEEAKLAILNAIKTGYRHLDTAALYQSEESLGEAVSEAIQLGLIKSRDELFITSKLWPCDAHPDLVIPAIQNSLRNLKLEYLDLYLIHFPISTKPAAGLVFPPPKDALLPMDYKSVWAAMEECQKLGLTKSIGVSNFSCKKLQTILDIANIPPAVNQVEMNPVWQNLQLRDFCKDKSIILTAYSPLEGKGTPWGSNAVYGAQVLHEIAEAKGKTHAQVCLRWVYEQGVSLLVKSFNDQRMKENMMIFDWELTEDELEKISRIPQRRGLPGDFFVSEAAPFKTVEEFWDGEI

SEQ ID NO: 913 - protein, 321 aa, Papaver bracteatum
MENAIPAVTLNSGSVMPVLGMGTAAYPFVESEEAKLAILNAIKTGYRHLDTAALYQSEESLGEAVAEAIQLGLIKSRDELFITSKLWPCDAHPDRVVPTLQNSLRKLKLEYLDLYLIHWPVSSNPVAGHVLSLPKDSLVTMDYESVWAAMEECQKLGLTKSIGVSNFSCKKLQTILDIANIPPAVNQVEMNPVWQNLKLRDFCKANNIVLTAYSPLGARGTPWGSNAVYEERVLHEIAEAKGKTHAQVCLRWVYEQGVSLIVKSFNELRMKENMMIFDWELTEDELQKIGKIPQRRGLPGDFFVSEAAPFKTVEEFWDGEI

SEQ ID NO: 914 - protein, 323 aa, Papaver bracteatum
MENVIPAVTLSSGSVMPILAMGTAAYPLVEPEEAKLAFLNAIKIGYRHFDTAASYHCEGFLGEAIAEALQLGLIKSRDELFITSKLWPCDAHPDLVIPAIQNSLRNLKLEYLDLYLIHFPISTKPAAGLVFPPPKDALLPMDYKSVWAAMEECQKLGLTKSIGVSNFSCKKLQTILDIANIPPAVNQVEMNPVWQNLQLRDFCKDKSIILTAYSPLEGKGTPWGSNAVYGAQVLHEIAEAKGKTHAQVCLRWVYEQGVSLLVKSFNDQRMKENMMIFDWELTEDELEKIGKIPQSRGLPGDVFVSELEAAPFKTVEEFWDGEV

SEQ ID NO: 915 - protein, 319 aa, Sanguinaria canadensis
MENVSVVTLNSGREMPILGMGTAAYPSVGSEEAKLAILLAIKVGYRHFDTAAAYQIESSLGEAVAEALQLGLLKSRDELFITSKLWCSDSHPERVLPALQNSLRNLKLEYLDLYLIHWPVSLKPGNFDLTIPKEDLLPMDYKSVWAAMEECQKLGLTKSIGVSNFSCKKLQDLLATANIPPAVNQVEMNPIWQQKKLREFCKANGILITAYSPLGANGTPWGSSGVANTEVLHQIAKARGKTHAQVCLRWVYEQGVSLLVKSFNEERMKENLKIFDWELTAEDLKQISEIPQHRGLPADIFVSVNGPFKTVEEFWDGEV

SEQ ID NO: 916 - protein, 321 aa, Sanguinaria canadensis
MEISVPITTLSSGREMPILGMGTAENLFNGSEKVKLAILDAIKVGYRHFDTAAVYQTESSLGEAVAEALQHGLLKSRDELFITSKLWCSDSHPDRVLPALQTSLRKLKLEYLDLYLIHWPLSSKPGSHDYPIPKEDLLPLDYKSVWAAMEECQKLGLTKSIGVSNFSCKKLQDLLDTANIPPAVNQVEMNPLWQQKKLLEFCKGNGIIITAFSPLGAKGTSWGATNGVMDSEVLHQIAQARGKSIAQVSLRWLYEQGVSLVVKSFNVERMKENLKIFDWELSAEDLKKINEIPQRRGLPSGSFISANGPFKSEEELWDGEV

SEQ ID NO: 917 - protein, 318 aa, Sanguinaria canadensis
MAMETVPKLPLSSGDNSIPVIGFGTAAFPLPDDETLKSAFLNGIEAGYRHFDTAAAYGSEKALGEAITEALRLGLLKSREEVFITTKLWCSSCERSLVVPSLKNSLRNLQMEYVDLFLIHWPVRLSIDAQRPPIPREQILTFDTKSVWEGMEECHELGLAKNIGLSNFYPKKIDELLATAKIPPAVLQVELSPTWQQKNLIEYCREKGILVTAYSALGANGTHWGDNRVVESDVLGDIAKARGKTTAQIALRWVYEQGVCMVVKSFNKERMKLNLQIFDFELTEEESNKISQLPQIKGVKLSPMFGNHDVLKELEDQL

SEQ ID NO: 918 - protein, 328 aa, Sanguinaria canadensis
MGEEMKCGRVVPVATLNSGRTMPLLGMGTAAYPFVGSEKVKSAILHAIKLGYRHFDTAALYQTEECLGEVVAEALQLGLLKSRDELFITSKLWCSDSHPDRVLPALQTSLRKLKLEYLDLYLIHWPLSLKPGNYGFPIPKEDMLPMDYKSVWAAMEECQKLGLTKSIGVSNFSCKKLQDLLATANIPPAVNQVEMNPIWQQKKLREFCEANGILITAYSPLGANGTPWGSSGVAQTQVLHDIAKARGKTHAQVCVRWVYEQGVSVLVKSYNEERMKENLTVFDWELDVEDLKKISTEIPQRRGLPSDIFVSVLTGPFKSAEELWDGEL

SEQ ID NO: 919 - protein, 326 aa, Sanguinaria canadensis
MESDSTAVAVPVTTLSSGIEMPMLGLGTADEKLLPSSETVKLAFLTAIKLGYRHFDTAAVYQTEECLGEAVAEALQLGLIKSRDELFITSKLWCSDAHPDLVIPALQNSLRKLKLEYLDLYLIHWPLSSKPGNCVFPIPKEDLLPLDFKSVWAAMEECQKLGLTKSIGVSNFSCKKLQDLLAMAIIPPAVNQVEMNPHWQQKKLREFCKVKDIVVTAYSPLGAKGTPWGSNAVMDSKVLHQIAKARGKSVAQVSLRWVYQQGVVLLVKSFNEERMKENMKIFNWELNEEDLKMIDEIPQCRGNPSHYYVSENGPFKTVEEFWDGEV

SEQ ID NO: 920 - protein, 307 aa, Sanguinaria canadensis
MPIVGMGTAENLFEGSERVKLALLTAIKVGYRHFDTAAVYQTEGSLGEAIAEALQLGLIKSRDELFITSKLWIHDCHHDLVLPALQNSLRKLKLEYLDLYLIHWPVSSKPGELRSLIPKEELLPMDFKSVWVAMEECHKIGLTKSIGVSNFSCKKLQDLLLTANIPPAVNQKVEMNPLWQQKKLREFCKANGIVIAAYSPLGAKGTLWGTNGVMDSEVLQQIAKARRKSIAQVSLRWVYEQGVVLLVKSFNEGRMKENLKIFDWELSREDLKQINEILPQRRGLPSHVFVSDDGPFKSEEELWDGEV

SEQ ID NO: 921 - protein, 318 aa, Sanguinaria canadensis
MTMEAVPKVTLSTSGKSMPIIGFGTALFPTGNDEAVKSAVLSGIEAGYRHFDTAVAYRSEKGLGEGIAEALRLGLILSRDEVFITTKLWCTSCERSLVVPSLKNSLRNLQMEYVDLFLIHWPLRLSADAQRPPIRNDQILHFDTKSVWEGMEECYELGLAKNIGVSNFYPKKIDELLATAKIPPAINQVELNPAWNQKDLIKYCKSKGILITAYSALGANGTHWGDNRVVDSDVLKDIAKARGKSTAQVALRWVYEQGVSMVVKSFNKERMKQNLQIFDFELTEEESNKISQLPQHKGVKLTPVYGDHDAMKKIDNEI

SEQ ID NO: 922 - protein, 319 aa, Tinospora cordifolia
MVSVPEVVLSNGHLMPVVGMGMAAYPFQESETVKQAMIRAIKMGYRHFDTAALYQTEKSLGDAIVEALKLGLIKSRDELFITSKLWCSDAHPHHVIPALQRTLRNLGLEYLDLYLIHWPVSSEPGKYEFPVRKEELILMDFENVWADMEEGYRLGLTKSIGVSNFSCKKLESLLTMAKIPPAVNQVEMNPLWRQNKLLRFCKDKGIAITAYSPLGAKGTIWGTNRVMESEVLNDTANAREKTLAQVCLRWVYEQEVSILVKSFNEERMKENLDIFDWKLSDEDLEKINEIPQCRGLPGDIFVSDDGPFKSEAELWDGEI

SEQ ID NO: 923 - protein, 329 aa, Tinospora cordifolia
MVGVNKENVVSSVATVPVVTLNSGHKMPVLGTGTASFPVPPLEELKKVIMEAMEVGYRHFDTAAMYQSEEGLGAAIKEALEKGLIKSRDELFITTKLWCNNAQPHLVLPAIRDSLRRLRLEYVDLYLIHYPVRLKEDLLSMDCKEDEIFPIDIKSVWSAMEEIHNLGLAKSIGVSNFTCKKLTDLLAHAKIPPAVNQVELHPAWQQKKLREFCQEKGIQVSAYSPLGAKQWGFDVVLSNKIIKEIAHHKGKTVAQIALRWGHEQGIILIPKSFNKERLIQNLLIFDWELTQDELKKMASIQQSRIAIAPEFVFPGSPFKSFEEFWDGEM

SEQ ID NO: 924 - protein, 321 aa, Tinospora cordifolia
MGISMPDATLNSGHRIPLIGFGTASFPFPLEGSETATRAILEAIKIGYRHFDTAALYQTEVGLGEAIEEALHLGLIESRDELFITSKLWCTHGRPERVLPAIRESLKNLKLDYLDLYLIHMPMSFKSEKPWFPLPGEFEAMDFKSVWEQMEACQRLGLARSIGVSNFSCKKLQLILTTANIPPAVNQVEMNALWQQNKLREFCKSEGIVITAYSPLGGKGTSWGSNRVMECEVIKEIATEKGKTHAQVCLRWLYEQGVSMVVKSFNKERMKENLEIFDWELTSKECEQIKKLPQSRGFTAQGLVSEDGPFKSIEDIWDGEI

SEQ ID NO: 925 - protein, 333 aa, Thalictrum flavum
MRRPHSRLASTRDMSSIVPDVVLSSGHKMPLIGFGTVAYPIAASDSIKTAIVNGIKHGYRHFDTASVYQTEQLLGEAIAEALQFGLIKSRQELFITSKLWCSDSHHDRVLPALQNTLKTLQLDYLDLYLVHWPISSKPGKHEFPIPKEELLPLHFESVWTAMEECQAVGLTKSIGVSNFSSKKLEQLLSTSKIPPAVNQVEMNPIWQQYKLREFCKSKGIVITAFSPLGAKGTSWGTNKVMDSEVLNEIAQAKGKTHAQVCLRWLHEQGICVVVKSFNEERMKENLEIFDWELSPEESALIQQLPQSRGNTGEDFISVDGPFKSLEELWDGEI

SEQ ID NO: 926 - protein, 320 aa, Thalictrum flavum
MGSIPEVSLNSGHRMPLIGMGTASYPFAGSEVVKSAILSAIKLGNRHFDTAALYKTEQIIGEAIAEALQLGLIKSREELFITTKLWVNDGHKDCILPALQTSLKNLQLDYVDLYLIHWPVCIPPGELRMPGPNEKVLPIDYASVWEAMEECQRHGLTKSIGVSNFTCKKLELILASAKIPPAVNQVEVNPLWRQEKVIRFCKDRGIAVTAYSPLGTAGSDFMGNRNVVQSELLKEIAKATGKTHAQVCIRWVFEQGVGVIVKSFKEMRLEENIDIFDWELSKEDSLKISRLPESKGYPGHGFIRVEGPFKSLEELWDGEI

SEQ ID NO: 927 - protein, 320 aa, Xanthoriza simplicissima
MGSVPEITLNSGHSMPVLGLGTASVPFAGYEVVKSAILSAIKLGYRHFDTAALYRTEQPLGDAIAEAIRLGIIKSREELFITSRPWLNDTHHDRILPALQTTLQNLQLDYLDLYLIHWPLSIKPGNIRFPGPDEKILPMDFESVWAAMEECQRLGLTRSIGVSNFSCKKLEKILASATIPPAVNQVEVNPLWRQEKLIQFCKSKGIVITAYSPLGTVGSSFQGNNNIMECEVLKEIAGNRGKTHAQVCLRWVYEQGVCLLVKSFNEARLKENMEIFGWALSEEEANQINQLPQGRGYPGHNFITPDGPFKSEEELWDGEI

SEQ ID NO: 928 - protein, 349 aa, Argemone mexicana
MAENNSSIITTNVTNPYEYLKIVHNSEDDTLTRLDPVPITNPITNVQNCKDIPLNIQHKTWIRLFKPPQLQQQKSSKKDDEFSKSLSNNQSFPLIIYFHGGGFIMNSAASNYEHVFCEFVTTRIPAFIASVEYRLAPENRLPAAYDDAVEALNWVKNQALDTINGEQWLRNFVDFSKCFIMGCSAGGNIAYHACLRTLELDLEPIKISGFILNQPYFGGLRRTESELRLINNWMLPLVINDLMWELSLPIGANRDHVYCNPMVDIDNSSSTILGLVKKLGLIRMKCLVIGCDGDPLIDRQIEFVKLLKEKGVMVESCIEEGGFHGVGFSCPEKTDELCVKLKDFILGTY

SEQ ID NO: 929 - protein, 326 aa, Berberis thunbergii
VDQSQSQTPINPYNLLGLVHNSDDTLTRLISPTCRYEDDQSIIQDIPLNTAHKTWLRLFKPIESPRITNGDKLPIILYFHGGGFILCSAAQTIFHDFCTSLANKLPAFILSVEYRLAPESRLPAAYNDAVQAINWVRDQALNLNGEPLLREFGDFSKCFLMGCSSGGNIVYHAGLQALDLDIEPLKIRGLVLNQPFFGGTQRTKSELRLVDDKILPLSMSDMMWELALPRRVDRDHKYCNPMIHGDDDKKNGLIKRCFVSVRSGDPLMDHQMEFVRMLERKGVHVVRWFDDNEKEGYHGIELYEPQKAEVLFAALIDFVYSSEATE

SEQ ID NO: 930 - protein, 257 aa, Chelidonium majus
MLPIIIYFHGGGFILFNADSTMNHDFCQSIATHIPALVVSVDYRLAPENRLPAAYDDAVDALNWVKDQGLGKLNNSEVWLKEYGDFSKCFIMGCSSGANVAYHASLRAIEMDLEPAKINGLILHCPFFGSLERTESDSKVINNQDLPLAVRDVMWELALPLGSTRDHVYCNPNIDHDGSSSGNMVGLIERCFVVGFYGDPLIDRQIQLVKMLEEKGVKVETWIEQGGYHGVLCFDPMIRETFLEKLKHFILNDEFIY

SEQ ID NO: 931 - protein, 320 aa, Cissampelos mucronata
MDPYKFLSISPNPDGSLTRHTRIPTSPPTNNPTVASADFPLNPSNNTWFRLYKPTNTPTSAKVPIVIYFHEGGFVLFSAASQPFHDCCAALASQLQALVMSVEYRLAPEHRLPCAYDDAIDAIAWVRGQALGGGNGWFGDSVDFSRCFLMGSSSGGNIVYKAGLMSLEKGLIGGGAEHVKLVGLIMNQPFFGGVERTDSELRYADDRILPLPAGDLLWELALPTGSDRDHEFCNPLKGVSGEIERLPRCFVNGYCRDPLIDRQRQFAKMLERNGVSVVERFVDDGFHACELFDPDKARALALAIKDFIYDCGAGGAKSAL

SEQ ID NO: 932 - protein, 354 aa, Cissampelos mucronata
MRNKRMAALSFDNARLGHQVGQDHRQKPGVLIEEIDGLIRVYKDGHVERPPVVPNVDCIAYIESSLTCRDVIIDKFTNVWARFYVPRTQGTKLPFLVYFHGGGFCVGSAAWSCYHEFLTKVATKAGCVIMSVNYRLSPEHRLPTAYEDGVGALMWVRREILRGSSEQKWWWSHCNFSQVFIVGDSAGANIAHHVTTRVGQLGASSDEPNILSPMTLKGTILIQPFFGGEARTHSEKYMAQPPKSALTVAASDVYWRLSLPLGASRDHRWCNPIAKGAMDLEELRVPPIMVCISELDILKDRNLEFCSAMKRAGKRVEHVVYMGVGHAFQVLNHSQLSQARAHEMMSHIKAFINR

SEQ ID NO: 933 - protein, 344 aa, Cocculus trilobus
MAGSNAVNESQRAVPLNTWILISNFKVAYNLLRRPDGTFNRHLAEFLDRKVPANVIPVEGVFSFDCFIDRATGLLSRIYRPAPADEAEILPGVIDLERPLSTEVVPVIIFFHGGSFAHSSANSAIYDTLCRRLVRNCKAVVVSVNYRRAPENRYPCAYDDGWAALKWVHSRPWLRSGEDSKVHVYLAGDSSGGNIAHHVAMRAVEAGTEVMGNILLNPMFGGMDRTESEKRLDGRYFVTIQDRDWYWRAFLPEGTDRDHPACNPFGPKGADLKGVKFPKSLVVVAGLDLVQDWQLAYVEGLEKAEQEVKLIYLERATIGFYLLPNNDHFYSVMNEINKFVNSNC

SEQ ID NO: 934 - protein, 361 aa, Eschscholzia californica
PQLLILTTYFKIIIKLKYFFNLSSLSTMEDKSSSLISNINPYEALQLVYDAQADSLTCNLPVPTIESSGDPNCKDIPLNIEKKTWVRIFRPTTITTPTTTSVTTATTTTNKLPIIIYFHGGGFILFSAASGMFHDFCKSMAAQVQALVVSVEYRLAPEKRLPAAYDDATDAINWVRNQAMDPVNGEPWLRDYADFSKCFLMGCSAGANISYHVGLKACELDLEPIKISGLILNQPFFGGSKRTESEIRLRDDQILSNPVIDLMWKLSLPIGVDQDHVYSNPMANNGGGNVKVIKRIFVNGCDGDPLFDRQVEFVKMLEDKGLKVEASMEEGGFHGMTFLDPKQTDFFCKKLKDFIFLSQVV

SEQ ID NO: 935 - protein, 352 aa, Glaucium flavum
MQSSSPQIKNTNKTRKNPNPTMADQPPTTINPYEALKIVHNPDDTLTRNLPIPDTPSSDDPNCKDTSLNPQHKTWIRIFRPTKTQSQDNDFSITNKLPIIVYFHGGGFILCSAFSTIFHDFCKNMATQLPALVLSVEYRLAPESRLPAAYDDAVDALNWVRNQALETANGEEWLRDYADFSNCFIMGCSAGGNIAYHTGTRALELDLEPIKISGLILNQPYFGGVERTGSELRLINDKALPLAMNDMMWELGLPIGADRDHFYCNPMVKIDGESGTRDEGKLGLRMIRCLTIAGYDDPLFDRQIELGKMLEGKGVKVVRFIDKEGYHGMVHFDQKKAEEMFVAVKDFISSTN

SEQ ID NO: 936 - protein, 317 aa, Hydrastis canadensis
MADQNSSVEPIDPYKFLNIIYNPSDDTLTRNNHFPSTPITPDVKNAKDISLNTTKKTWVRLFRPNEPSLNRKLPIIVYSHGGGFILQSASDTVFHNFCASMANILPALVVSIEYRLAPESRLPGAYEDTIEAINWVKNQALDMNGEQWLKDFADFSNCYLMGSSAGGNIVYHAGLRALSLDLDPLIIKGFILNSPFFGGSKRTESELRLINDTLLPLAVNDLMWELSLPKGCDRGHEYCNPMVDSSYKQNIGLIEKCFVSVGGEDPLMDREMEFVKMLKEKGVKVVVWFDKEGLHGMEITVPGKDQALFVLLKSFVY

SEQ ID NO: 937 - protein, 330 aa, Hydrastis canadensis
MANPNPVTIDPFKQLIITLNPDGTLTRPTLVPIVPPTGEINSHSKTPSVISMDVPLNPSKNTWIRVFQPSNLSSNSKHPLIIYFHGGGFVLYSAASKPFHESCCQMASELSAVILSIEYLLAPENKLPSAYEDAEDAMLWVKKQALNCEYKFCEFVDFSKCFIMGSSSGGNITYQAGFRALKLDLEPITINGVIMNQPFFGGVERTESELRLINDRILPLPTCDLMWEFALPIGSNRDHEYCNPIGSHHNEIKWLPRCYVRGYGGDPLIDRQMKFVKMLEDHGACVVKHFLDDGFHACELFDPKMAEALYVDLRDFIYSSESNAVVKSKY

SEQ ID NO: 938 - protein, 325 aa, Jeffersonia diphylla
MDPYDALNFILNPDGSITRLDSSVPTTPPTGYDYNDSSVASIDVPLNTTTNTWIRIFHPLNLPSDTKLPIIVYFHGGGFLLFSAASLTLHDFCVHLAGETPALVLSVDYRLAPENRLPAAYEDAVDAVLWLKQQALHGEHKFTTFVDFTQCFIMGSSSGGNIAYHAGLRALNLNISPVEIRGLILNIPFFGGVERTESELKCVDDPILPLPVADLMWELALPVGTDRDHEYSNPMVEGSNQKDIQRLPTCYVNGYEMDPLVDREKQLVEKLKGHGVCVVEHFFDDADAYHAVEFFDPDKGRALVMDLKDFIYSPVTAASVDKPIE

SEQ ID NO: 939 - protein, 329 aa, Menispermum canadense
MENQQPPLLNTTDPYETLKIVYNANDDTLTRLYPIPCTAATGDHHNLPIITKDICLNTTHKTWLRLFIPTEPPPSPNSLPLIIYFHGGGFVLCSAANTLFHDFCARIAADLPAVVASVEYRLAPERRLPAAYEDAVEAVNWVREHGIKEKWTRDFVDFSKCYLMGNSSGGNIAYRAGLRCGSLDLEPVKIVGLVLIQPYFGGVERSESEMRLANDGHFPLVVNDLMWELALPRGADRDHEYCNPMVAGAQWEKIGKCFVSVRGGDPVMDRQIALARRLEGEGVKVESWFEEEGYHGIELFDPVKASELLLKLKHFICPPEAAEYRVVEK

SEQ ID NO: 940 - protein, 333 aa, Menispermum canadense
MDDPYKFLNIVPNPDGSLTRLTQIPTSPPSHHPEATSNKSINSSLNDHSVISMDFSLNPATNTWLRLFRPNTTTPQHVKLPIIIYFHGGGFVLFSAASQPFHDSCAAMAADLPALVLSVEYRLAPEHRLPAAFHDAVDAIVWVKQKALEQHWLCDLADFSKCFLMGSSSGGNIAYHAGLRALGLDLGPVKVSGLILNQPFFGGVVRTESELRLAGDRILPLPAGDLMWELALPVGSDRDHEYCNPIMKDSNGGDIERLPRCFVNGYGGDPLVDRQKEFVKMLEQCGVSEVARFVDDGYHAVELFDQSKAKDLVMAIRAFIYTTSATTTPKSTL

SEQ ID NO: 941 - protein, 327 aa, Menispermum canadense
SDLRDPSVIDEPYQFLKIALNPDGSLTRGYEFPRVPPTPELASESANLSSRRQPALSKDIPLNTSNQTFLRLFRPLHHSKKLPIIIDFHGGGFVILSAISAPFHDMLSRAAAFAPALIITVEYRLAPEHRLPAAYDDAMEAIMWVRDQAREINGCDPWMKELADYSNVHIMGTSAGGNIAYQAGLRALDVDINPVQIRGLILNQPFFGGIQRTQSEEILSRNPYLPMAVSDLLWVLSLPPGSDRDHEYSNPLDGVNQKIQCLPRCLIRGFAGDALVDRIKGLAKMLDAHGVKVVVKIEDGGFHGAEMADPSKVQELFLQIKDFVYSS

SEQ ID NO: 942 - protein, 268 aa, Nandina domestica
PIQQTLSNSGELKLPLVLYFRGGGFILCSVANTFFHNFCTSLATNLPALILSVEYRLAPESRLPAAYDDVIEAINWVRNQGLDMHGGEEWLRKYGDFSKFFLMGCSSGGNMAYHAGMHALGLDIKPLKIQGLILNQPFFGGTKRTESELRLVNDQKIPLAVSDLMWELALPKGVDRDHKYSNPMVHDDDDDQEKIELMKGCSWFVSMRGGDPLMDRQMEFVRMLEKKDVKVVKWFDDEGYHGMELFEPQKAEELLVALKNFIRSEALE

SEQ ID NO: 943 - protein, 323 aa, Nandina domestica
MDPFKVLNLIPNPDGSFTRPPIFPYAPPTGYTDSTPPQNVATIDVPLNSMKNTWIRIFHPLNLPSVSTKLPVILYFPGSGFVMDTARILPLNEFCIQIAGELPVVILSVQYRLAPENRLPSAYEDAVDAMLWLKQQALHGEHKFIDSADFTKCYIMGSSSGGNMAYQAGLRALNLDLEPVRINGLIMNQPFFGGVERTGSEMKYENDKVLPLLATDSMWELSLPIGADRDHEYCSPMVQVWDLVQIQKLPKCYVNGHGGDLLVDRQKEFVKMLEGQGVSVIAHFFDDGCHAVELFDQEKAQALYMDLKEFIYSSTTGDGAHGS

SEQ ID NO: 944 - protein, 320 aa, Nigella sativa
MADENPNSVALDPYKVINIVLNPDGSLTRPTQVPNLPTSDDPKSVISLDIPLNPSNKTWMRVFQPPNLSSNQKLPLIIYFHGGGFILYSPSSRPFHVSCIQMATQLPAIILSVDYRLAPENKLPSAYDDAVDALLWVKNNAMKGEYKFWEFIDLSKCFIMGSSSGANITYHVGLKALVLDLEPVKIKGLIMNQPFFGGIQRTGSELRFVNDKVVPLVVADLMWEFCLPVGADRDHQYCNPMAEGGSEEEEIKELPRCYVRGHDGDPLIDRQKEFVEMLEGRGVSVVKDFSDDGFHACELFDATKGQELIEKVKEFIYSSS

SEQ ID NO: 945 - protein, 325 aa, Nigella sativa
MADENPNSVALDPYKVINIVLNPDGSLTRPTQVPNLPTSDDPKSVISLDIPLNPSNKTWMRVFQPPNLSSNQKLPLIIYFHGGGFILYSPSSRPFHVSCIQMATQLPAIILSVDYRLAPENKLPSAYDDAVDALLWVKNNAMKGEYKFWEFIDLSKCFIMGSSSGANITYHVGLKALVLDLEPVKIKGLIMNQPFFGGIQRTGSELRFVNDKVVPLVVADLMWEFCLPVGADRDHQYCNPMKGSQNQEIKRLPRCFVRGYGGDPLIDRQKEFVKMLEEEGASVIKYFLEDGFHACELFFPDKAQALYVDLKDFIYSSPETNKSTL

SEQ ID NO: 946 - protein, 321 aa, Nigella sativa
MAAQNQNSTINPFEALSIVLNANGSLTRHPHPLSTLSLNTTKSVVCTDIPLNPNRNTSIRIFQPPIHPTTPKIPLIIYFHGGGFLIFSAKSPPYSEFCLQIASELPALVLSVGYSLAPEDRLPSAYEDALDAVVWVKNHAFKGEYKYDFFDYVDFSKCFIMGSSSGGNITYQLGLQALKLNLEPFRINGLIMIQPFFGKVERSGSELRLANDNILPLPVTDLMWELSLPVGADRDHQYCNPMAEGGSEEEEIKELPRCYVRGHDGDPLIDRQKEFVEMLEGRGVSVVKDFSDDGFHACELFDATKGQELIEKVKEFIYSSS

SEQ ID NO: 947 - protein, 326 aa, Nigella sativa
MAAQNQNSTINPFEALSIVLNANGSLTRHPHPLSTLSLNTTKSVVCTDIPLNPNRNTSIRIFQPPIHPTTPKIPLIIYFHGGGFLIFSAKSPPYSEFCLQIASELPALVLSVGYSLAPEDRLPSAYEDALDAVVWVKNHAFKGEYKYDFFDYVDFSKCFIMGSSSGGNITYQLGLQALKLNLEPFRINGLIMIQPFFGKVERSGSELRLANDNILPLPVTDLMWELSLPVGADRDHQYCNPMKGSQNQEIKRLPRCFVRGYGGDPLIDRQKEFVKMLEEEGASVIKYFLEDGFHACELFFPDKAQALYVDLKDFIYSSPETNKSTL

SEQ ID NO: 948 - protein, 315 aa, Nigella sativa
MDTFKQLSITYNPDDDTIDRLVTIPCTTTNHHNSLPNQQIFTHDIPLNSSHKTSLRLYKPINPPLHAKLPLVVFIHGGGFLFASPFNTIYNDFCTSMAISLGVVVLSVGYRLAPESRLPAAYEDALEALTWVRDQADNILLKDMVDFSNCYLMGDSAGGNIVYHAGLRALSINLEPLVIKGYIFIQPFFGGMKRTESEVRLADDKILSSVVSDLLWELGLPKGSDRDHEYCNPMVGGGFSDKIELLTRCFLVALGGDLLVDRQKEFMKMLEEKGVEVVSWFEDEGCHGMFLFEPEKALHLFEVIKDFIYQPMPTV

SEQ ID NO: 949 - protein, 330 aa, Papaver bracteatum
MADQHSTTTSSTIDPYEALMVVHDPDLDTLTRNLPLQITNTTDDPNSKDILLNAQHNTWIRIFKPTIQDLPTANKLPVIIYYHGGGFILCSTFWTIYHDYCKSKANALPAIVLSVEYRLAPESRLPAAYDDAVDALNWVKHQASGGKPSEPWLRDYADFTNCYIMGESAGGNIAYNVSLRASELDLSPLKISGVILNQPFLGGIERTSSELRLINDKILSLPVSDLMWELSLPIGSNRNHPYCNLLINEDDESLRKKCGFIKKCLVIGCDGDPLIDRQVEFVKMLEGKGVKVETFMQEGGYHGMVYFEPEELEIMLPRVKDFILSGASKL

SEQ ID NO: 950 - protein, 324 aa, Papaver bracteatum
MADQHSIDPYEALMVVHDPDLDTLTRNLPLQITNTTDDPNSKDILLNAQHNTWIRIFKPTIQDLPTANKLPVIIYYHGGGFILCSTFWTIYHDYCKSKANALPAIVLSVEYRLAPESRLPAAYDDAVDALNWVKHQASGGKPSEPWLRDYADFTNCYIMGESAGGNIAYNVSLRASELDLGPVNITGVILNQPFMGGIERTSSELRLINDKILSLPVSDLMWELSLPIGSNRNHPYCNLLINEDDESLRKKCGFIKKCLVIGCDGDPLIDRQVEFVKMLEGKGVKVETFMQEGGYHGMVYFEPEELEIMLPRVKDFILSGASKL

SEQ ID NO: 951 - protein, 240 aa, Papaver bracteatum
MIVYFHGGGFILCNANSTIFHNFCKSMANQLSAIVLSVEYRLAPENRLPAAYEDAVESLVWVQNQALDAINGEPWLRNYGDFSKCFIMGCSAGGNIAYNSCLGASELDLEPIKICGLILNQPYFGGVERSKSELRLVNDKCLPSVVNDLMWELGLPVGVNRDHVYCNPFVDENLETKLRFIRRCLVTCSNEDPLVDRDIQFVKMLEGKGVKVVSWIEEFGFHGMAHSDPVKAQELLKVVK

SEQ ID NO: 952 - protein, 351 aa, Sanguinaria canadensis
DHHQLSQLAASVNYSIDPYDRLKIVHNSDDDSLIRLVPLPSYPSTDDDDQNSCKDILLNPQHKTSIRIFRPTTTQFQQSSKKYDFSVKNKLPPIIYFHGGGFILGSAFNIVFHDYCKSMATQLPALVLSVEYRLAPENRLPAAYDDAMDAVNWVRNQALDAINGEPWLRDYADFSKCFLMGFSAGGNIAYHAGLRALELDLEPIKISGLILNQPYFGGSKRTRSELRLTNDPILPCPMSDLMWELALPRGANRDHMYCNPMVDDVTRRGNRNKVGLVIRRCLMAGCDGDPLIDRQIEFVKMLEGKGVKVETWMEEGGSHGMVFADPKKAEILFGKLKDFIFTDIVTKGAAN

SEQ ID NO: 953 - protein, 299 aa, Sanguinaria canadensis
SIDVPLNTDKNTWIRIFLPSNLPSNNSKLPIIIYFHGGGFIVFSSASLPYHEFCVRLASELPAVILSVEYRLAPESRLPSAYEDAIDAINWLKKQALNGGEHKFVDFVEFTGCFLMGSSSGGNIAYQAGLRVADLDIEPVKINGLILNQPFFGGVERTGSELRYANDEILPLPVSDLMWEFALPIGANRNHEYCNPMVEKSHYCKIRMLPRCLINGNGRDPLVDHQKEFVKMLERNGVCVVAHFADDGSHAVELFDPEMARALVTNVRKFIYSSATDVGVSTTGAAKSSIPIDRLLFCK

SEQ ID NO: 954 - protein, 324 aa, Stylophorum diphyllum
ESLPPINPPSYKPLTMADQSSTTINPYEALNIVHNPDDTLTRNLPIPDTPSSDDPNCKDIPLNPQHKTWIRIFRPTKTQFQDDQNKKIPVIIYFHGGGFIICSPSSTIFHDFCKSMAIQSSALVISVEYRLAPESRLPAAYDDSVDALNWVRDQALDVINSEEWLREYGDFSNCFIMGESAGGNIAYHACLRSLELDLEPIKITGLILNQPFFGGVERTGSELRLINDKVISIVMSDLFWELGLPIGADRDHFYSNPMMVENNGGTSTINWLMIKRCLVIGKMLERKGVKVVSWIEEEGCHGKVHSDQKHAEEMFKVVKDFIRA

SEQ ID NO: 955 - protein, 340 aa, Tinospora cordifolia
MEDHDDVPSINPTDFFKSLKIIYNPETDTLTRLFTVPCTNPTNTDDDHHHSPAVSSQPVLTKDLPLNSSYHTWLRLFLPTGPPPSKKLPLIIYFHGGGFIFMSAANTMFHDFCSRVAVELPAVVLSVEYRLAPESRLPAAYDDAVDAIHWVREQALVAGDDKGHDLEDVWLREQVDFPTCYLMGLSAGGNIAYHASLRSLHLDLDPLKIVGIILIQPYFGGVQRTASEMRLGNDENFTVGMTDVMWELSLPKAADRDHEYCNPMVGDYGEKIGQLGRFLVCVRGGDMLRDRQMELVKMIEEKGGKVKCWFEEEGYHGVELSDCEKASELLVKIKHFIYEK

SEQ ID NO: 956 - protein, 340 aa, Tinospora cordifolia
MEDHDDVPSINPTDFFKSLKIIYNPETDTLTRLFTVPCTNPTNTDDDHHHSPAVSSQPVLTKDLPLNSSYHTWLRLFLPTGPPPSKKLPLIIYFHGGGFVFLSAANTMFHDFCSRVAVELPAVVISVDYRLAPESRLPAAYDDAIDAIYWVREQALVVGDDKAHDLKNVWLREYVDFSTCYLMGLSAGGNIAYHASLRCLPLDLEPVKIVGMVLIQPFFSGVQRSGSEMRLGNDGMFTLDMSDAMWEYALPKGADRDHEYCNPMVGDYGEKIGQLGRFLVCVRGGDMLRDRQMELVKMIEEKGGKVKCWFEEEGYHGVELSDCEKASELLVKIKHFIYEK

SEQ ID NO: 957 - protein, 337 aa, Tinospora cordifolia
MSDQVAPFTPVPITDPYDYVDLVHHHDGTITRKKPSNFPTVPTVPDLSYPAPVLSKDIPINQSNNTWARVYISRYKLESNSTNDLLPLIVYYPGGGFVISTTATPTCYNFCSKLALQLSAVVVSIDYRVGPEHLLPAAYDDAVEALNWIKFAEDSWLRDHANLSNCFIMGCSAGGNIAYHVGLRVAMEDVDSFKPLKINGLILHYPFFGGHERTESELRMANDLILPLIATDVMWKYSLPAGANRDHEYSNPAVVDRSKLFDKIKMLGWKILMSTGDKDPGIDRQIGLLTTMKEKGVKVKGRIVEGDHHGEELLNNSHKLDSLLVALKDFIFSTFSE

SEQ ID NO: 958 - protein, 330 aa, Thalictrum flavum
MAVPLNTWVLISNFKLAYTMLRRPDGTFNRHLAEFLDRKVPSNANPVDGVFSFDVIIDRATDLLCRVYRQALATEGRPSFLQLEQPLSSDVVVPVIIFFHGGSFAHSSANSAIYDTLCRRLVRNSKAVVVSVNYRRAPEYRYPCAYDDGQAALKWVHSRPWLRSGKDSKAHVYLAGDSSGGNIAHHVALRAVESGTEVLGNILLNPMFGGVERTESEKKLDGKYFVTLQDRDWYWRAFLPQGADRTHPACNPFGPNAASLEGVKFPKSLVVVAGLDLLHDWQLAYVQGLQRAGQDVKLMFLEQATIGFYLLPNNIHFFSLMDEINNFLSC

SEQ ID NO: 959 - protein, 326 aa, Xanthoriza simplicissima
MAEQNPSILPINPYEVLGIVHNPDDTLTRQIQIPCTTTSTDDISCAKITKDIPLNACNKTWLRLFRPIEQPVNVKLPIILYFRGGGFILCSASNTIFHNFCASMANKFPALIVSVDYRLAPESRLPSAYEDAIEAITWVKKQALDTNGEQWFKDLADFSKCYLMGCSSGGNIVYHVGLRAISLDLKPLLIKGLILNQPFFGGLRRTESEMRMVNDKTLPLVVSDLMWELALPAGSDRDHEYCNPRVDGGFKENIKLLSRCFVSVRGGDPLMDHQKEFVKMVEEEGVKVVNWFDEAGYHGMELFEPQKAEAMFVALKAFIYSSSDIE

SEQ ID NO: 960 - protein, 323 aa, Xanthoriza simplicissima
MASQADQAHVDRYKEHNIIYNPDDTLTRLITFPCTSTTDHNSLPNQPVFTQDIPLNPINKTWMRLFKPSNPQPPKTKLPLILYFHGSGFIIGSASNSTFHDFCTSMAIELSCVVLSLGYRLAPESRLPAAYEDAMEAIDWVRNKALDLGSDNCLKEVVDFSKCYLMGISSGGNMVYHAGLRVLSMDLHPMIIKGLILNHPFFGGLKRTNSELRLANDKFSLAFTDIMWELSLPKVFDRDHEYCNPMVEGSNKDKIGLLGRCFVSGCGGDILIDRQMEFAKMLEEKGASVVTWFEEEGCHGVELFEPEKTRALFFLLKEFISGQ

SEQ ID NO: 961 - protein, 326 aa, Xanthoriza simplicissima
MADQNTIIDPYKHINVVLNPDGTLTRPTLVPIIPPSSDPNSNSVISLDIPLNPSKSTWMRVFQPPNLSCNQKLPLIIYFHGGGFVLYSASSRPFHESCVKMASELPAIIISVDYSLAPENKLPSAYEDGMEALLWVNNQAINGEFEFCKFVDFSKCFIMGSSSGANITYQVGLRALKLDLEPVKIIGLIMNQPFFGGIQRTGSELRMVNDRIIPLVVADLMWELALPIGADKDHEYCNPMAAHFNEIKQLPRCFVNGYGGDPLVDRQKEFAKMLGEHGACLVEHYSDDGFHACELFIPDKAQALVMNIRDFIYSPGIGSNAATSTL

SEQ ID NO: 962 - protein, 491 aa, Argemone mexicana
MDILSISVIAIVITSLLYLILRDSSPKDLPPGPKPWPIVGNLLQLGEKPHSQFAQLAKTYGDLFTLRLGTETVVVASTPLAANEILKTHDRILSGRYVFQSFRVKHHVENSIVWSECNDTWKNLRKICRTELFTQKMIENQAEVRERKTWEMIEFLKKKEGEEVKIVEIIFGTLVNIFGNLIFSKNIFELGDENSGSVEMKKHLWRMLELGNSTNPADYFPFLGRFDLFGQRKDVADCLQGIYDVWGVILKERKVEKKKRIDEEEKKKNDFVDILLDSGLDDQQINSLLMELFGAGTETSASTLEWGIAELTKNPKIKTKIRSELMTVVGQNTVKESDIPNLPYLQAFVKETLRLHPPTPLLLPRRALDTCRVLNYTIPKECQIMVNAWGIGRDPKTWNDPLTFSPERFMNSNIDFKGNDFELIPFGGGRRICPGVPLATQFISLIIATLVQNLDWELPMGMDPSDLIMEEKFGLTLQKEPPLFIVPKFRV

SEQ ID NO: 963 - protein, 443 aa, Berberis thunbergii
MSKNSPPFLDYMSNIAQKYGPLVHLKFGLHSSIFASTKEAAMEVLQTNDKALSGRKPLPCFRIKPHIDYSIVWSDSNSYWKNGRKILHTEIFSQKMLQAQEKNRERVAENLVNFIMTKVGNVVELRSWLFGCALNVLGHVVFSKDVFEYSDQSDEVGMDKLIHGMIMTGGDFDVASYFPFLARFDIHGLKRKMDEQFKLLIKVWEGEVLARRANRNPEPKDMLDVLIANDFNEHQINAMFLETFGPGSDTSSAIIEWALAQLIKNPDKLAKLREELDRVVGRSSTVKESHFSELPYLQACVKETLRLYPSVTIMIPHQCMETCQVMGYTIPKGMDVHVNAHAIGRDPKDWKDPLKFQPERFLGSDIEYNGKQFQFIPFGSGRRICPGLPLAVRTIPLVLASLVHAFDWELPDGVPNEKLDMEELFTLTLCMAKPLQVIPKVRI

SEQ ID NO: 964 - protein, 489 aa, Berberis thunbergii
MGPLALFALVFIIPFLLLITLFKPSSKNLPPGPPAWPLIGTLLPKLKKQPHVELTKLAKSHGPLMLLKFGVEPVVVASNHVAAMEVLKTHDRELSGRFAPHSVRIKGYVEHSMVWADCTDYWKLVRKIWRTDMFSTKMLDAQACVREEKVLELVGFLKGKQGEVVKFADVVFGCILNILGAIVFSQNVYDFEDKSDNELGMKGMIRQLMILAAIPNLADLYPILGKSDFQGLKKASAACVTRMNESWATVVKERRRNSDHLKNDFLNVLIKAGFSDPQIDAMLLEIFGPGSDTSASTIEWAMAELLKSPEKLKNVQNELKKVIGANQVVKESDLPDLPYLNACVKETLRLHPPVTFLLPHRALEECQVMGYTVPKGSQLMVNTYAIGRDPETWNNPLSFEPERFLSDTEIDYQSSTDMKYIPFGAGRRICPGLSLAARLVPLVLASLIHAFDWGLPGGMDPSEIDMKDKFGLALLKDDPLLIIPKVTKV

SEQ ID NO: 965 - protein, 484 aa, Berberis thunbergii
MDLNTALLYLIPVVLVYYILFKPKHKNLPPGPKPWPLIGNIPVLFGSGKPLHVTLTDMARTHGPIITLWMGTQPTAIASTAESAMEILKTHDRLFSGRAVRMSFRLKHHIKYSLVWADCSEYWKLLRKIVRTEIFSPKMLQVQEHVREKKMEEMVEFLKGKEGEVLKLSPLVFGTLLNVLGNVVYSKDVFGYFGDDGDQMQTLMKEMLMIGAAPNVAEFWPILEELDLQGLKKKCHERFTEVMKMWKGTVEERKVNRNAEPKDMLDVLLANDFNDDQINALFLETFGPGSETSSATIEWTMAELIKNPKIIAKVREELDQVVGKSLVKESHLPNLPYLQACIKETMRLHPAAPFLLPHRSVEACQVMGYTIPKDIQVLVNAYAIGRDPKTWKDPTTFKPERFMESDIDYYGKHFEFIPFGSGRRQCVGMPLATRTIPLIVSNLVHAIDWSLPDGKNLEELVMNETLSLSLALDPTLTVIPKARV

SEQ ID NO: 966 - protein, 490 aa, Berberis thunbergii
MEEVLGESNLFFLLLLALLPFFFFILNYIKSPTLPPGPFSWPIIGNLLKMGTKPHVSLAQLAHTYGPIISLRLGTRLLVIGSSPSAAIEILKTHDRLLSARTIPDASPTKDPAHTKFSLAWADCTDQWKYLRTICRSELFSIKAIESQSKMREEKVIELVKFLGTKDGQLVRIDEVVFDTMVNMLSNIFVSQDFVNMEERDSEEGLRGLVRKFVEVAATPNIADFYPILSVLDLHGLKKRSKELFVKICDLWGVMIKERREGKTGNKDFLDFLLANGFINDQINCLLLELFSAGSDTSTSTIEWAMAELMKNEEAMKNVLSELEREIHTNMVKESDLPQLPYLHACVKETLRLHPPAPLLLPHRALETCKVMNYTIPKDTQVLVNVWAIGRDPMVWNDPLAFKPERFLDSNSLDMNLSDFRFIPFGAGRRICPGLPMATKQVALILASLINCFHWSLPHDMHPLELDMEEKFGVTLQKEQPLVLIPRVKT

SEQ ID NO: 967 - protein, 492 aa, Corydalis chelanthifolia
MEILSIAILSVVISTLIYYFFFSDSKAQKGLPPGPKPWPIVGNLLQLGDKPHSQFAEMAQIYGDLFTLKMGTETVVVASTPAAAIEILKTHDRLLSARYVFQSFRVPNHVENSMVWSDCNEVWKMLRKVCRTELFTPKMIEAQAHVRESKALEMVKFLKGKQGGEVKIAEVVFGTLVNIFGNLIFSQDVFELGDPSGGSAEMKEHLWRMLELGNSTNPADYFPILGRFDLFGQRKDVAECLRLIYDVWGVMLKERKVKKAAQGNKGNDNKDFVDVLLDSGLNDFQINALLMEIFGAGTETSSSTIEWSITELTKNPHITAKLRAELESVVGQNPVKESDIPNLPYLQACTKETLRLHPPTPLLLPRRAIETCKVMNYTIPKDCQIMVNAWAIGRDPKIWKDALSFSPERFLNSSVDFKGNDFELIPFGAGRRICPGVPLATQFISLIVATLVQNFEWNLPNGMDPKDLVMDEKFGLTLQKEPPLYIVPKSRV

SEQ ID NO: 968 - protein, 493 aa, Corydalis chelanthifolia
EFFSITILSLLITSLIYYLFSDHSKTQKGLPPGPKPWPIVGNLLQLGDKPHSQFYEMAKTYGDLFTLKMGTQTVVVASTPAAATEILKTHDRLLSARYVFQSFRIPKHVENSMVWSDCTDAWNMLRKICRTEIFTTKMIEAQAYVRESKVLEMVKFIKGKQGSEVKVLKVVFETLVNVFGNLIFSQDVFQMGDPSGEGAVMKGHIWRMLELGNSTNPADYFPILGRFDLFGHRKDVEECLRQIYDVWGVMLKERKAKKAAIQEKGGNYNNSDFVDVLLDSGLEDFQMNILLMELFGSGTETSSSTIEWAMAELTKSPDIAAKLREELSSVVGQRPVKEADIPNLPYLQAITKETLRLHPSTPLCIPRRAPETCQVMNHTIPKDCQIIVNVWAIGRDPKAWEDACKFSPERFLNSSIDFKGNDFELIPFSAGRRICPGMPIAIQFVNLFVATLVQNFEWDLPNGMDPRDLVMDDKFGLTLQKEPPLYIVPKSRV

SEQ ID NO: 969 - protein, 488 aa, Chelidonium majus
MEIITVALIAVVISSILYLIFRDTSPKGLPPGPKPWPIVGNLLQLSDKPHAQFAELAQTYGDLFTLRMGTQTVVVASTPTAAAEILKTHDRILSGRYVFQSFRVKEHVKNSIVWSECNDTWKSLRKVCRTELFTQKVIESQAEIRERKAWEMVEYLKKKQGEEVKIVEVIFGTLVNIFGNLIFSQNIFDLGDPSSGSVELKEHLWRMLELGNSTNPADYFPIMGRFDLFGQRKEVEDCLQGIYDVWGAMLKKRKAAKEAGNSEGGNDFVEILLDSGLTDQQINSLLMELFGAGTETTASTLEWAITELTKNPNVTAKMRSELETVVGHNTVKESDIPNLPYLQAFVKESLRLHPPTPLLLPRRALETCRVLNYTIPKECQIMVNAWAIGRDPKIWTDPLTFSPERFLNSSIDFKGTDFELIPFGGGRRICPGIPLATQFIGLIAATLVQNFEWDLPNGMSPKELNMEEKFGLTLQKEPPLYIIPKSRA

SEQ ID NO: 970 - protein, 495 aa, Cissampelos mucronata
MEVVAATIGLIAFAIFIYIFFIKDQSSKKGLPPGPKPLPIVGNLLQLGDQPHAQFAQLAQTYGDLFSLKLGSQTVVVASTPAAATQVLKTHDRIFSGRYVFQSFRVEKHVNNSIVWSECNENWKMLRKVCRTELFSAKMIESQAHLREAKAMELVKFLKGREGQVVKITEVVFGVLVNIFGNLIFSQDVFDLSDPTGGSAEMKDHIWQMLEMGNSANPADYFPFLGRFDLFGQRRAVANCLQQIYDVWGAMLRERRRAAKKGDGSTPPHHDFVSILLDAGLDDQKINALLMELFGAGTETSSSTIEWAIAELTKNPSIKEKLLLELDNVVGKEEVKESDIPRLPYLQAFVKETLRLHPATPMLLPRRALETCQVMGYTIPKDCQIMVNAWAIARDPKIWKEPLRFLPERFLDSSLDFKGNDFEFIPFGGGRRICPGIPLATQFIGIIVATLVQNLDWSLPNGMDPSELVMEEKFGLTLQKEPPLLIVPKAKDLCK

SEQ ID NO: 971 - protein, 492 aa, Cissampelos mucronata
MEVVTLLLSLLSSIPLILLVYLLLLLKPKPNLPPSPPSWPLIGSIPAILGSSKPLHLTLTDLAAAHGALMLVTLGTAPTVVASTRAAAMEVLKTHDKSLSGRHIRMSFRIKEMNRHSLVWSNCTDTWKLLRRLARTEIFSPKMLQAQEPVRERKVGELVHFLREREGAVVKISEFVFGTLLNIIGNVVFSKDVFGYGDKNEIGMQSLIKELLVIGASPNVAEFYPILEVLDLQGLRRRCADRVARVNMLWESTVKKRRISRGGDPEDMLDVLLDNGFNDVQINVLFLEMFGPGSETSSATIEWALAELIKNPDKLAKVREELDRVVGPTSQVNEAHIPHLPYLQACIKETMRLHPAAPFLLPHRAVETCQVMGYTIPKDYQLLVNAYAIGRDPESWNEPSKFMPERFLESEVDYNGNHFEFIPFGSGRRICIGMPLATRTVPLIVSSLMHNFSWSLPDGRRNEELEMNEMLSLSLAIDPSLTIIPKARILHA

SEQ ID NO: 972 - protein, 497 aa, Cissampelos mucronata
MDQLTLLSLILLSTLLICLLFSFEFKRYISKRLPPGPFVWPMIGTVFMSVSEAQDHIVLADLARKYGPLMMVKFGLAPPLMVASNHAAAAEILKTHDVACCGRDPPHSVKLPGYIEHSMVWGDCTEHWKMVRKIWRTELFSAKMVDSQAGIREEKVRELVGFLRGRGGEVVQLTEAIFGCIINVLGSIIFNKNVYDYEGRVDNEKGMKGMIRELIMLAATPNLPDFFPVFGLLDLQGIGKRTGECVKRMNEYWGVIVKERRASKDHSRNDFLDVLIQAGFTDAQIDALLLEIFGPGSDSTSCTIEWAMSELIKNPNKLLKLQEELNTVIGQNREVKESDLENLPYLHACIKETLRLHPPVTFLLPHRATKTCEVMSYTIPKESGIFVNTYAIHRDPTVWEDSSMFKPERFLNSTVDYQGNDFQYIPFGAGRRMCPAHNMASRTTRIMLASLIHNFEWSLPNGMAPSELDMQDTFVMVLAKAVPLSVIARERSVCVSS

SEQ ID NO: 973 - protein, 447 aa, Cocculus trilobus
VSATIGFIFFIIFIFFFLKKQNTSTKGLPPGPKPWPIVGNLLQLGDKPHAQFAQLSQTYGDLFSLKLGSQTVVVASSPTAATQVLKTHDRILSGRYVFQSFRIEKHVNNSIVWSECNDNWKMLRKVCRTEVFSTKMIESQAHLREAKAIEMVEFLKGREGQVVKIAEVVFGTLVNIFGNLIFSQDVFDLADPTSGSADMKDHIWKMLEMGNSANPADYFPFMGKFDLFGQRRAVAECLQQIYDVWGAMLKERRGAARGGTGANNDFVSVLLEAGLDDQRINALLMELFAAGTETSSSTIEWAIAELTKNPPIREKIYRELESVVGKERVKESDIPRLPYLQGFVKETLRLHPATPMLLPRRALETCQVMGYTIPQDCQIMVNAWAIARDPKVWKDPLKFSPERFLNSSLDYKGNDFEFIPFGGGRRICPGLPLASQVHKASLWQLLC

SEQ ID NO: 974 - protein, 483 aa, Cocculus trilobus
LSLLSFIPFVIVLYLLFKPKHNLPPSPRPSWPLIGNIPAILGSKTPLHVTLTDLAQVHGPLMVVTLGTAPTVVASTREAAMEVLKTHDRALSGRHIRMSFRIKEMNKHSLVWSNCTDTWKLLRKLARTEIFSPRMLQIQEPVRENKVGELVEFLRGREGKVVKISQFVFGTLLNIIGNVVFSKDVFLFDDDKIGMQSLIKELLMIGASPNLAEFYPILEVLDLQGLRRRCADRVSKVNKLWESTVKERRLGRSGDAKDMLDVLLDNGFSDVQINVLFLETFGPGSETSSATIEWVMAELIKNPDKLAKLRLELDQVVGPTSQVKEAHIPLLPYLQACVKETMRLHPAAPFLLPHRAVETCQVMGYTIPQDYQVLVNAYAIGRDPESWKDPSEFRPERFLESNVDYNGNHFEFIPFGSGRRICIGMPLATRTVPLIVSSLVHNFYWSLPDGKSPEELEMNEILSLSLAIDPSLSINPKVRALNT

SEQ ID NO: 975 - protein, 488 aa, Eschscholzia californica
MEVVTVALIAVIISSILYLLFGGSGHKNLPPGPKPWPIVGNLLQLGEKPHAQFAELAQTYGDIFTLKMGTETVVVASTSSAASEILKTHDRILSARYVFQSFRVKGHVENSIVWSDCTETWKNLRKVCRTELFTQKMIESQAHVREKKCEEMVEYLMKKQGEEVKIVEVIFGTLVNIFGNLIFSQNIFELGDPNSGSSEFKEYLWRMLELGNSTNPADYFPILGRFDLFGQRKEVAECLKGIYAIWGAMLQERKLAKKVDGYQSKNDFVDVCLDSGLNDYQINALLMELFGAGTETSASTIEWAMTELTKNPKITAKIRSEIQTVVGERSVKESDFPNLPYLEATVKETLRLHPPTPLLLPRRALETCTILNYTIPKDCQIMVNAWGIGRDPKTWTDPLTFSPERFLNSSVDFRGNDFSLIPFGAGRRICPGLPIANQFIALLVATFVQNLDWCLPNGMSVDHLIVEEKFGLTLQKEPPLFIVPKSRV

SEQ ID NO: 976 - protein, 488 aa, Glaucium flavum
MEIVTIAVIAVVISSIFYFIFRDTSPKGLPPGPKPWPIVGNLLQLGEKPHAQFAELAQTYGDLFTLRMGTQTVVVASSPSAAAEILKTHDRILSGRYVFQSFRVKEHVENSIVWSECNDTWKNLRKVCRTELFTQKMIESQAHIRERKAWEMVEFLKKNEGQQVKIVEVVFGTLVNIFGNLIFSQNIFELGDPSSGSVELKDHLWRMLELGNSTNPADYFPIMGRFDLFGQRKEVADCLQGIYDVWGAMLKERKAARKAGGNQGKNDFVEVLLDSGLNDQQINALLMELFGAGTETSASTIEWAITELTKNPKVTAKIQSELLTVVGRSSIKESDIPNLPYLQAFVKETLRLHPPTPLLLPRRALDTCRVLNYTIPKECQIMVNAWAIGRDPKTWTDPLSFSPERFLNSSIDFKGNDFELIPFGAGRRICPGVPLATQFIGLIVATLVQNFEWGLPNGMKPGDLNMEEKFGLTLQKEPPLYIIPQSRA

SEQ ID NO: 977 - protein, 488 aa, Hydrastis canadensis
MELLSIAIAFLFFFFLRIIFHDSNRKNLPPGPRPWPIIGNLLQLGEKPHAEFAKLAQTYGDLFTLKLGSQTVIVASSPASATEILKTHDRILSSRYIFQSFRVKDHVENSIVWSECNENWKLLRKVCRTELFSPKMIESQAHVREAKALDMVKFLKRKEGEVVKMVEIVFGTLVNIFGNLIFSKDVFDLEDPTGGSAEMKEHLWKLLDMGNSTNPADYFPIMGKFDLFGQRKAVAQVLQQIYDVWGVMLKERRNRKGSENNHDFVNVLLDAGLDDQKINALLMEIFGAGTETSASTIEWAIAELTKNPRVLSKIASELVNVVGEETVKESHLPNLPYLQAFVKETLRLHPPTPLLLPRRASDTCQVMNYTIPKDCQIMVNAWGIGRDPKTWNDPLTFKPERFLNSNVDYKGNDFELIPFGAGRRICPGLPLASQFINLIVATLVQNFEWSLPQGMSPSELTMEEKFGLTLQKEPPILLVLKARVSIKS

SEQ ID NO: 978 - protein, 486 aa, Hydrastis canadensis
MDLTIALFSFIPIILVFVLLLKPKTKNLPPGPSAWPLIGNLPTLFSNPNVPLHVTLTNLAKTHGPVMLLWLGTQPTVIASTDEAAMEILKTHDRVFSGRHVRMSFRLKHHIKYSLVWSDCTDYWKLLRKIARTEIFSVKMLQVQSHVREQKVAELVEFLRSKQGQAVKISQFVFGTLLNILGNVVFSKDVFIYSDEEDKEGIQPLIREMLMIGAAPNVAEFYPILEELDLQGLKRRCADRFIQVMKLWEGTVKERKQNRNEESKDMLDVLLANDFNDAQINALFLETFGPGSETSSATIEWVMAELIKNPNEMAKVRKELDEIVGASNVKESHLPHLPYLQACIKEAMRLHPAAPFLLPRRAVEKCEVMGYTIPKDCQVLVNAYAIGRDPKTWKGPSTFRPERFLESDIDYHGGHYQFIPFGSGRRTCIGMPLATRTIPLIVGSLVQTYDWSLPGGKRPEELEMKEMLSLSLAIDPSLCVVPKLRA

SEQ ID NO: 979 - protein, 497 aa, Hydrastis canadensis
MEETFVVIRKANLFYYLLLLVLSLLFLILKHIRSPNNLPPGPFPWPIVGNILNMGNRPHISVAQLAKVHGPLMSLRLGTQLVVVGSSPAAATEILKTHDRILSGRCVPHATPASPNDVHLSMSWSDCTDQWRLLRTLCRTELFSAKVIESQANVRDKKVVELVEFLATKEGKMVQIVEVVFATIFNMLSNLFVSRDFIKLDEKREDGGVKGLIKGLVELGFTPNLADLYDIFSGFDLQGLNKKSKEMFLKICGVWEVIVKERREGKSNDTSRQRDYLDALLDSGLTNGHINYMFLELFLAGTDTSTSTIEWAMAELIKNPEAMKKVKIELEREINGNVVTESDLPQLPYLHSVVKETLRLHPPAPFLVPHCALETCKVMNYTIPKDTQIFVNVWAIGRDPNIWDDPLTFKPERFVESSMDLNSNNFRFIPFGSGRKICPGLPMAAKQVPLVLACLIKCFDWSLPHDITPSKLNMDEKFGITVQKEKPLVLIPKVKKS

SEQ ID NO: 980 - protein, 485 aa, Jeffersonia diphylla
MELITGVVIAISFFLVYLLISNRLSRKGLPPGPRPWPIIGNLLQLGEKPHAEFAKLAQKYGDLFTLRLGTETVVVASSPAAAAEILKTHDRILSGRYVFQSFRVKEHVENSIVWCQCNDNWKMLRKVCRTELFTPKMIESQAHVREAKALEMVSFLRGKQGEVVKISEVVFGTLVNIFGNLLFSQDIFDLADPTSGSVEMKDHLWKMLQLGNSTNPADYFPFLGRFDLFGQRRAVADCLQRIYDIWGALLKERRGSNASKDHHDFVNVLINAGIDDQKINALLMELFGAGTETTASTIEWAVAELTKNPHIAAKVRQELLNVLGKDPIKESDIPRLPYLQAFVKETLRLHPATPLLLPRRALETCQVMNYTIPKDCQIMVNAWGIARDPKIWNDAMTFSPERFLNSSVDYKGNDFELIPFGGGRRICPGIPLATQFIHLIVATLVQNFEWKLPKEMDPSDLTMEEKFGLTLQKDPPLYIVPKSTL

SEQ ID NO: 981 - protein, 483 aa, Jeffersonia diphylla
MELTTALLYLIPTIFLIIFLKPRNKNYPPGPNPWPIIGSIPALFGSGTPMHVTLADMAHTHGPLMMVWLGTQPTAVASTAESAMEILKTHDRLFAGRAIRMSFRLKHHIKYSLVWADTSEYWKLLRKIVRTEIFSPKMLQVQEHVREEKVAELVEFLKGKEGQVVGVSQLVFGTLLNILGNVVFSKDVFAYVGAEGDKMQTLIKEMLMIGAAPNIAEFWPIFEEFDFQGLKKKCDQRFKVVMQMWEGTVEERKVKRNEEPKDMLDVLLVNDFNDAQINALFLETFGPGSETSSATIEWAMAELIKNPNIMAKVRAELDQVVGKSTVKESDLPHLPYLQACIKETMRLHPAAPFLLPHKSMETCKVMGYTIPKGIQVLVNAYAIGRDPKTWKDPTTFKPERFLESDIDYYGKHFQFIPFGSGRRQCVGMPLATRTIPLIVSNLVHKIDWSLPDGKRPEELVMNETLSLSLALDPTLSVIPKLRV

SEQ ID NO: 982 - protein, 484 aa, Mahonia aquifolium
MDLITCLAILTLFFFLYFFITDHLSRKGLPPGPRPWPIIGNLLQLGEKPHSEFAKLAQTYGELFTLKLGTQTVVVASSPAAAAEVLKTHDRILSGRYVFQSFRVMEHVENSIVWCQCNDNWKMLRKVCRTELFTPKMIESQAHVREGKALEMVRFLRSKQGQVVKMTEVVFGTLVNIFGNLIFSQDVFELGDPTSGSVEMKEHLWRMLELGNSTNPADYFPFMGRFDLFGQRRDVAECLRQIYKIWGVILEERRRSGSKQNNDFVDVLLNAGIDDKKINALLMELFGAGTETSASTIEWAIAELTKNPHVTKKLRNELLNVVGKATVKESDIPRLPYLQAFVKEVLRLHPPTPLLLPRRALETCQVMNYTIPKECQIMVNAWAIGRDPKTWTDPLTFSPERFLNSSVDYKGNDFELIPFGGGRRICPGVPLATQFIHLIVATLVQNFEWTLPKEMDAKDLTMEEKFGLTLQKDPPLLIVPTARI

SEQ ID NO: 983 - protein, 484 aa, Mahonia aquifolium
MDLKTAFLYLIPIVLVYYILFKPKHKNLPPGPKPWPLIGNIPVLFGSGKPLHVTLTDMARTHGPIITLWMGTQPTAIASTAESAMEILKTHDRLFSGRAVRMSFRLKHHIKYSLVWADCSEYWKLLRKIVRTEIFSPKMLQVQEHVREKKMEEMVEFLKGKEGEVLKLSPLVFGTLLNVLGNVVYSKDVFGYFGDDGDQMQTLMKEMLMIGAAPNVAEFWPILEGLDLQGLKKKCHERFTEVMKMWKGTVEERKVNRNEEPKDMLDVLLANDFNDDQINALFLETFGPGSETSSATIEWAMAELIKNPKIIAKVREELDQVVGKSLVKESHLPNLPYLQACIKETMRLHPAAPFLLPHRSVEACTVMGYTIPKDIQVLVNAYAIGRDPKTWEDPTTFKPERFMESDIDYYGKHFEFIPFGTGRRQCVGMPLATRTIPLIVSNLVHAIDWSLPDGKNPEELVMNETLSLSLALDPTLTVIPKARV

SEQ ID NO: 984 - protein, 484 aa, Menispermum canadense
MALLALFLIFALPILLLYFLKPSSPKNLPPGPFSWPLLGTLGLKSNEKQAHVVLTNLAQTYGPLMLLKLGVKPVIVASTHVAAMEILKTQDHVLSGRCPPHSVQVEDYIEASVVWADRNEHWKMVRKICRTELFSTKMLESQASIREERVSELIAFLRRREGEVVKISDVIFGCMINVLGSVIFNQSVYDFEGKKDTGMKGMIRELMILAATPNLPDFYPIFDRFDIQGLRSTTSACWKRMSESWAGIVKERRASRDHSRNDFLDVLIQANFTDPQIDALFLEIFAPGSDSTTTAMEWAMTELMRNPEKRLNVQNELKTVIGNRQVVKESDLPNLPYLHACVKESLRLHPPVTFLLPHKATETCQVMNYTIPKGTQLMVNAYAIGRDPKTWDDPLCFKPERFLNSEVDYQGNDFSLIPFGSGRRMCIGMPLASRVVRLIIASLIHNFDWSLPGGIKPSELDMQEMFELVLQKHVPLSIIPNARA

SEQ ID NO: 985 - protein, 494 aa, Menispermum canadense
MEIVSTVAIGFIFFIIFIIFFFSNQRSTKGLPPGPKPWPIVGNLLQLGDQPHAQFAQLSQTYGPLFSLKLGSQTVVVASSPSAATQVLKTHDRVLSGRYVFQSFRIDRHVNNSIVWSECNDNWKLLRKVCRTEVFSPKMIESQAHLREAKAIEMVEFLRGREGQVLKIAEVVFGTLVNIFGNLIFSQDVFDLADPTSGSAEMKEHIWRMLELGNSTNPADYFPIMGKLDLFGQRRAVAECLQQIYDVWGAMLKERRATKGTETNNDFVNVLLEAGLDDQRINSLLMELFAAGTETSASTIEWAIAELTKNPQIMAKIHSELESVVGKERVKESHIPHLPYLQAFVKETLRLHPATPMLLPRRALETCNVMGYTIPKDCQIMVNAWAIARDPKVWKDPLKFSPERFLNSSLDYKGNDFEFIPFGGGRRICPGLPLATQFISLIVGTLVQNMDWSLPNGMDPTELGMEEKFGLTLQKEPPLLIVPKSRDFLNETRG

SEQ ID NO: 986 - protein, 487 aa, Menispermum canadense
MDLAVLLSLFVPAILIYLLLKPKNVPPGPRSWPLLGNLLTVLRSHVPLHITLTDLARTHGPLMLVTLGTQPTVLASTSEAAMEILKTHDRALSGRHIRMSFRLKEMNKHSLVWSNCTDTWKLLRKIARTEIFSPKMLQIQEHVREQKVLELVEFLRGREYLGKAVKISQFVFGTLLNIIGNVVFSKDVFGFSCDEGGDEIGMQSLIRELLMIGASPNIAEFYPILEGLDLQGLKRRCKDRVDRVNKLWEGTVKERRLKRSGESKDMLDVLLDNGFDDVQINVLFLETFGPGSETSSATIEWVMAELIKNPDKLAKVRTELEQVVGLHSQVKESHLPHLHYLQACVKETMRLHPAAPFLLPHRAVETCRVMGYTIPKDCQVLVNAYAIGRDPNIWKDPSRFKPERFLESSVDYNGNHFEFIPFGSGRRICIGMPLATRTVPLIVSSLVHNFDWSLPDGKRPEELVMNEMLSLSLAIDPSLSIIPKVRG

SEQ ID NO: 987 - protein, 489 aa, Menispermum canadense
MALLALFLLFALPILLLYFLKTSSNPKNLPPGPFSWPLIGTLVMKLNEKRPHVVLTNLARTYGPLMLLTFGIEPIAVCSTPEAAMEMFKTQDRVMSGRYVPHSVQVKGYIEHSMVWADCNEYWKMVRKIYRTELFSTKMLEAQVSVREEKVKELMAFIKRKEGEVVKITDVVYGCILNILGSVIFNQNVYDFDGKTDNDAGMKGMVRQLMTLAGIPNFPDFYPIFGRFDPQGLKKKTTECVKRMNESWAGIVKERRASKDHSGNDFLDVLIQANFTDPQIDSLLLEIFGPGSDSSTSTIEWAMADLMRNPEKLLKVQDELETVIGRNREVKESDLPNLPYLHACVKETLRLHPPVTFLLPHRATETCQMMNYTVPKGTQTTVNTYAIGRDPKAWEDPLCFKPERFLNSEVDYQGNDFHYIPFGAGRRICPAVSLASRVSRLIIASFIHDFDWSLPNGMQPSELDMEAKFGLVLWKDDPLCIIPQNQSPI

SEQ ID NO: 988 - protein, 495 aa, Menispermum canadense
MDSVLAILYLSIFFLTILLVKLFQHKSHKSNQLPPGPRPWPILGNLVSILGSKTPPHITFANLARAHGGLMLLWLGQKPLVVVSDKEAAVEVLKTHDRVLSGRSITVSFRFREKTEYSLVWADCNDYWKLLRRILRTEIFSPKMLKIQERVREQKVTELMELMRSSEGKEVTIRPLVFGTILNILGNAVFSKDMFELGGRGDKVGLEQLIRELLTIGSTPNIAAFFPIFEKLDPQRLKKRTWERLVKIDKLWESIVKERRQQERSEECKDMLDVLLANDFTDPQIDNIFLETFGPGSESSSATVEWVMSELIKNPQTFAKLRQELDNEFGQSKVITGSRLTNLPFLSAVIKETMRLHPAIPFMLPHRAVETCEVMGYTIPKDMEIQLNAYAIGRDPKAWKDPNTFRPERFLESDIDYQGNHFELIPFGAGRRVCPGLPLAVKNTPLIVSSLVHGFDWSLPDGLTHDQLQMNEVLSVALTKDPSLCLIPKVRIWAS

SEQ ID NO: 989 - protein, 502 aa, Menispermum canadense
SHALRLLLLLLLLFLFFFRDSSSKNLPPGPPPFPIIGNLHQLGSKPHSTLAQLAQTYGPLLSLRFGSQLVVIASSPAAASEVLKAHDNVLSGRHIIYNARSKNYVEHSMVWAPECNEAWKNLRRICRLELFSPKAMEARAGVRELKVEEMVGVLRGKVGEVVKVSELVFGTIFNVLGGLIFSKDVFDMRREDGVVVGDLKGHLCKMLELGSAVSLADCFPKLGWMTGGRKVSEECRRNVFGSWEEIIRERRELSSNYGVGLGDGCDDDDDDGAKKDFLSSLIKAGFSNDQINTLLLDIFGAAADTTTSTIEWAMVEIMKNPHVLHKLQSELQLILMETSSKKNNIITEADLSHLPYLQATVKETLRLHPPTPLLLPRRALQTCKVMNYTVPKNSQILVNAWAIGRDTNVWENALKFWPERFLEDYKLGNNSFNFVPFGGGRRICPGMPLAAELTPLILGSLFHNFDWSLPMGMTPYDLTTEEKFGLTLQKDPPLLLVPKERH

SEQ ID NO: 990 - protein, 529 aa, Nandina domestica
MDLAILIFSFILLLFVFLVLNDHLGRKGLPPGPRPWPIIGNLLQLGEKPHAEFAKLAQKYGDLFTLRLGSQTVVVASSPAAAAEILKTHDRILSGRYVFQSFRVKEHVENSIVWCQCNDNWKMLRKVCRTELFTPKMIESQAHVREVKALEMVKFLKTKQGEVVKVAEVVFGTLVNIFGNLIFSQDVFDLADPTSGSVEMKEQLWRMLELGNTTNPADYFPFMGRFDLFGQRRAVAECLQQIYDIWGVMLKERRANSTRNVNNDFVNVLLSAGLDDQKINALLMELFGAGTETTSSTIEWAIAELTKNPRIVRKIQQELLNVVGEAATATVKESHIPHLPYLQAFVKETLRLHPPTPLLLPRRALETCQVMNYTIPKECQIMVNAWAIGRDPRTWNDALVFTPERFLNSNVDYKGNDFELIPFGGGRRICPGIPLATQFIHLIVANIVHNFEWSLPNGMDVGKLTMEDKFGLTLQKDPPLYIVPKARTRYDLEHILPSINKIAGLNNISIIETTDLGGTDLFVNICIIL

SEQ ID NO: 991 - protein, 488 aa, Nandina domestica
MVVPFVLAFFVLFIAPFLLLFLLKPSPKNLPPGPFAWPLIGTILPNEKQPHVELTNLAQTYGPIMLLKFGVEHVVVVSTNEAAMQVLKTHDLVLSGRYAPNSVKIKGYIEYSMVWNDCNEYWKMVRKIWKTELLSTKMLDAQACVREEKVMELVDFLRGKRGHVVKFADLIYGCLLNILGAIVFSQNVYDFDDTSNNELGMKAMIRELMVLAANPNNLADLYPMLGGSDFQGLRKATAACVKRMNELWGSIVRERRKTNAHFKNDFLDVLIKADFSDPQIDAMFLEIFGPGSDTSTSTIEWAMAELLRSPEKLKNVRKELNNVVLGTKQVKESDLPNLPYLNAVVKETLRLHPPATFLLPHRAIEECQVMGYTIPKGCQLMVNTHAIGRDSKTWNDPLSFNPERFLLDTEIDYQSSTDFKYIPFGAGRRICPGLSLAARVVPLVLASLINTFDWSLPNGMDPSELDMEEKFGAALWKEVPLLIIPKVQ

SEQ ID NO: 992 - protein, 483 aa, Nandina domestica
MELTTSLLCFIPIILLYILFKPSNKNLPPGPKPWPLIGSIPALFGSGSPLHVTLADMARTHGPIMTLWLGTTPTVVASTPESAQEILKTHDKHFSGRAIRMSFRLKHHIKYSLVWADCSEYWKLLRKIVRTEIFSPKMLQVQEHVREAKVAELVEFLKGKEGQVVRLSQLVFGTLLNILGNVVFSKDVFRYADGEKDKMQKLIKEMLMIGAEPNLAEFWPILEELDLQGLKKRCNDRFLEVMKMWEGTVEERKVKRNEEAKDMLDVLLANDFNDAQINALFLETFGPGSETSSATIEWALAELVKNPKILAKVREELDRVVGESTVKESHLPYLPYLQACIKETMRLHPAAPFLLPHRSVEECNVMGYTVPKDYGILVNAYAIGRDPNSWKDPTTFKPERFIESDIDYYGKHFQFLPFGSGRRQCVGMPLATRTIPLIVSNLVHRIDWSLPDGKPVEELVMNETLSLSLALDPTLTVVPKVRV

SEQ ID NO: 993 - protein, 503 aa, Nandina domestica
MFMKIMEETIAMEGINFLFLLLLLVLVLVLLCFIYKYITSPTLPPGPFSWPIIGNILAIGKRPHVSLAQLAQAHGPLFSLRLGAQLVVVGSSPAAAHEILKVHDRLLSARSIPNAAPAKNPAYTYCSVGWADCTDQWKYLRNICGSELFSTKAIESQSKLREDKVIELVEFLGTKEGQVVNIGEVVFATAFNMLSNILVSKDFINLEGERGGEGMKGIVRTYVEVGITPNIADFYPILGVFDLQGLKRKSMESFVKICGFWEGIIKERRESKDGDVSMRQRDFLDYLLSIGFNNDQINHLLLELFLAGVDTTTPTIEWAMAELIKNQKTMKNVRDELEREINKNCVNESDLVRLPYLHSCIKETLRLHHPGPLSIPRRALETCKVMNYTIPKGSQVFVNLWAIGRDPMTWNDPLVFKPERFLDASVESNSSGFGWIPFGAGRRSCPGQPMANKQVPLIIASLIKRFDWSLPHDMNPSELNMDETFGLTLQREQPLILIPKVKK

SEQ ID NO: 994 - protein, 488 aa, Nandina domestica
MDLTSAILIIPFFAIPFILMAFKLKHKNLPPSPPGWPILGNLPTLFSHGNEPLHITLTNMAPTYGPLLLLRLCQKRIVVASTTEAAMEILKTHDRALSGRVIPSSFRIDYHIKHSIVWSDCNDTWKNIRKILRTEIFAPKMLQVQEKIREGKVRDMMNFIRGKQGNVVNVRQWVFGCLLNILGQAVCSKDVFVYSDDGDKVGMQTLLRDMLINSGTPNIGEYFPILDPLDLQWLRRQCNQLFRQGVKLWEGTVKERRLCRNEESMDMLDVLLANDFNDDQINALFLETFGPGSETSSSTIEWALSELIRNPDKMAKLRKELDQIVGKSTVKESHLPHLPYLQACIKETMRLYPSAPFLLPHKAVETCQVMGYTIPKGYGILVNVYAIGRDPKLWKDPLTFTPERFLECDDMNYNGTNFQFLPFGAGRRICVGWPLAERTIPLILSSLVHGFDWDLPDGKHHEDMEMNQVLHISLNKDPPLAVIPKMKA

SEQ ID NO: 995 - protein, 722 aa, Nandina domestica
MLLKFGVEPVVVASTNEAAMQVLKTHDLVSGRFAPNSVQIKGYIEHSMVWNDCNEYWKKVRKIWKTQMFSTKMLDAQAFVREEKVMELVDFLRGKQGHVVKFADLIFGCILNILGAVIFSQNVYDFDDTSDNELGMKGMIRQLMVLAAIPNLADLYPILGSSDFQGLRKASAACVKRMNEYWGSIVKERRKKNCHLKNDFLDVLLKADFSDPQIDAMLLEIFGPGSDTSTSTIEWAMAELLRSPEKLKTVRKELNNVVLGTKQLKESDLPNLPYLNAVVKETLRLHPPVTFLLPHQAIEECQVMGYTIPRGCPLMVNTYAIGRDPKTWKDPLSFNPERFLLDTEIDYQSGNDFKYIPFGAGRRICPGLSLAARVVPFVLASLINTFEWSLPNGMDPSELDMKDKFGLALLKEVPLLITTLFFLTSMAGISTSSTKRCAVVTGANKGIGLEICRQLPSNGVLVVLTARDEKRGVEAVENLRQCGLSDVVFHQLDLMNSTSIASLAEFIQTQFGKLDILVNNAAIHGTIIDNDALKAQSHGNAWSALTGAMVQTYELAEECINTNYHGTKGVTEALLPLLQLSNSARIVNVSSKIGQLENISNEWAKEMLSNVDNLTEEKIDDVLNEFLKDYKEGLLEIKGWPIAPSAYRISKAAVNAYTRILAKKFPMISINCCTPGFVKTDMSAHIGRLSVEDGAKAVVMIALLPDGGPSGLFFVQKEVASF

SEQ ID NO: 996 - protein, 496 aa, Nandina domestica
KSWKKPLQRKVSISLFLLLLVLVLLCFIYKYITSPTLPPGPFSWPIIGNILTIGKKPHISLAQLAQAYGPLISLRLGTQLVVVGSSPAAAMEILKVHDRLLSGRSIPDVIPAKNPAFTKCSLAWNDCTDQWKYLRTICRSELFCIRAIESQSKLREDKVIELVEYLGTKEGQVVNFGEVVFGIVFNMLSNILMSKDFINLEEEGEGEGMKGLVRTLVELGTIPNLADLFPLLSVMDLQGLKKKSTEAFVKICGFWEGIIKERREGRDKDVLIRQRDFLDYLLSIGFNNDQINRLLVELLLAGADTTTSTIKWTMVELMKNQDAMKKVCIELEREINENRVKESDLHRLPYLNSCTKETLRLHPPAPLLLPHRALETCKVMNYTIPKDTQVFVNLWAIGRDPMTWDDPLVFKPERFLDSNVESKLNDFGWIPFGAGRRICPGQPMAMKQAVLILASLINHFEWSLPCDISSSTLNMDEKFGITLQKEQPLILIPIIK

SEQ ID NO: 997 - protein, 486 aa, Nigella sativa
MEFFSIAIVSSFFFLFLIFILRDSRPKNLPPGPRPSPIVGNLLQLGDKPHSEFAKLSQTYGELFSLKLGTQTVVVASSPAAATEILKTHDKNLSSRYVFQSFRVKEHVANSIVWSDCSENWKLLRKICRTELFTPKMIESQAYIREAKALDMVKFLKKKEGEVVKIVEVVFGTLVNIFGNLIFSKDVFDLEDPNGGSAELKQHLWKLLEMGNSTNPADYFPFLGKFDLFGQRRAVAEVLHQIYDVWGVMLKERRAMNGTENDFVSVLLSSGLDDQKINSLLMELFGAGTETSASTIEWAIAELTKNPSIASKLQSELLSIVGDRAVKESDIPSLPYLQAFVKETLRLHPATPLLLPRRAPNTCKVMKYTIPKDCQIMVNAWAIGRDPKTWDDPLSFKPERFLDSNLDFKGNDFELIPFGGGRRICPGLPLASQFISLFIATLVQNFDWSLPQGVSSNDLSMDEKFGLTLQKDPPLLIVPKLRISSV

SEQ ID NO: 998 - protein, 486 aa, Nigella sativa
MDVQVALFSIIPAILAFLLISKFKNKNFPPGPPSWPLIGSMPILFNSVTPLHITLTNMARTYGPMMTLWLGTQPTVIASTPESAMEILKTHDRACSGRHIRMSFRLKHHIKYSLVWADCTDYWKLLRKIARTEIFAPKMLQAQSHAREEKVGELIEYLGRKQGQAVKINQFVFGTLLNILGSVVFSKNVFEFSDDDGDKESMQNLIKQMLMIGAAPNLAEFYPFLETLDLQGLKRRCDDRFTQVMKFWEGTVKERRERRNEESKDMLDVLLANDFNDSQINALFLETFGPGSETSSATIEWTMAELIKNPKEMAKVRKELDNVVGRSSVKESHLPELPYLQACIKETMRLHPAAPFLLPRRAVESCQIMGYTIPKGCQILVNAYAIGRDPKAWKEPDRFRPERFLETEVDYHGGHFQYIPFGSGRRTCVGMALATRTLPLIVGSLVNTYDWGLPDGKKPEELEMKEMLSLSLAIDPSLLVVPTLRA

SEQ ID NO: 999 - protein, 492 aa, Nigella sativa
MEINLYYYLLLLVLPLIFLIIKHIKSATNLPPGPFPWPVIGNILSMGTKPHVSLAQLAKSYGPVMSMRLGTQILIVGSSPAAATEILKTNDRVLSARKVVHALPASPDRLHFSVTWSDCTDQWKYLRTLIRTELFSAKVIESQGQMRERKVSEVVEFLRTKEGKPVKIGVIVFNTIFNMLSNLLVSRDLIDLHQENEDEGLKGFVRKFVELCSCPNLADYYTMLSGLDLQGLNKKARKMFQEISMIWEVIIKERRDAQSHGNNLSREPDLLDTMLDRKLTNDHISYLFLELFLAGTDPSTSTVEWAMAELMKNPNALKIVRSELATEINGSVIKESDLSRLPYLQSVVKETLRLHPAAPFLLPHRALETCKVMNYTVPKDSQVFVNIWAIGRDPNVWEEPMSFKPERFLNQSHNDLNSTNIPFIPFGAGRRICPGQPMVAKQVPLVLASLINCFEWSLPHGVHPTDLDMEEAFGIVLQKDKPLILIPQVILQ

SEQ ID NO: 1000 - protein, 489 aa, Nigella sativa
MLEMDYYYYLLLLVLPLVFLIWKHIKPPTNLPPGPFPWPVIGNILNLGNKPHVSLAQLAETYGPVMSLRLGTKLLIVASSPAAATEILKTHDRIFSGRTIPHAIPAYPDRIHLSMGWADCTDQWKFLRTLCRTELFSAKAIQSQANIREDKMKELVMFLATKEGQSVKIEEVVFNNIFNTLSNLFLSKDLMSLQEGDQLRNFVRTFIQLIFTPNLADYYSILSGLDLQGLNKKCKEMIEKICGVWGVIIRERRQEDKDSGVTRPRDFSDSLIHAGLTDEQINYLFMELFFAGADTSTSTIEWVMAELIKNPQVMRKVCGELESRKKETVIINDSDLPYLPYLHATVNETLRLHPPAPFLIPHRAIETCTIMNYTIPKDAQVFVNVWALGRDSKTWEDPMSFRPERFLESGIDINSGDFRFIPFGGGRRICPGLPLAAKQVPLLVANLINCFDWSLPLDMEPAHLCMDEKFGITLQMEKPLVLVPRKKKW

SEQ ID NO: 1001 - protein, 483 aa, Nigella sativa
LYYYLLLLVLPLIFLIIKHIKSATNLPPGPFPWPIVGNILNMGNKPHVSLSQLAETHGPLMSLRLGTQLLIVASSPSAATEILKTQDGILSGRTVPHAIPVSPDRLHLSLGWADCTAQWKFLRTLCRTELFSAKAIQSQANVRDDKVKELVMFLATKEGQSVKIAEVVFNNIFNTLSNLLLSNDLVSLQEGDQLRNFVRTFIQLISTPNLADYYSILSGLDLQGLNKKAREIFEKTCGVWEVIIRERRKEGESGGSRQRDFLDSLINSGLTNDQINYLLMELFSAGTDTTTSTVEWAMAELIKNPQVMRKARLELENEIKETAIIKDSDLPCLPYFRAIVNETLRLHPPAPLLLPHRATETCKLMNYIIPKDAQVLVNAWKIGRDSKTWEDPMSFRPERFLESGMDLSSSNFKFIPFGAGRRVCPGLPVAARQVPILVANLINFFDWSLPLDMEPGHLCMDEKFSITLQMEKPLVLIPSVKKR

SEQ ID NO: 1002 - protein, 487 aa, Papaver bracteatum
MEIVTAALIAIVITTFLYLIFRDSSPKGLPPGPKPWPIVGNLLQLGEKPHSQFAELAKTYGDLFTLKLGSETVVVASTPLAASEILKTHDRVLSGRYVFQSFRVKEHVENSIVWSECNDTWKKLRKVCRAELFTQKMIESQAEIRESKAMEMVEFLKRNQGSEVKIVEVVFGTLVNIFGNLIFSQNIFKLGDESSGSVEMKEHLWRMLELGNSTNPADYFPFLGRFDLFGQRKDVADCLQGIYSVWGAMLKERKIAKLHNNSKKNDFVEILLDSGLDDQQINALLMEIFGAGTETSASTIEWALSELTKNPEVTANMRSELLSVVGKRPVKESDIPNMPYLQAFVKETLRLHPATPLLLPRRALETCKVLNYTIPKECQIMVNAWGIGRDPKRWTDPLKFAPERFLNSSIDFKGNDFELIPFGAGRRICPGVPLATQFISLIVPTLVQNFDWGLPKGMDPSQLIMEEKFGLTLQKEPPLYIVPKNRD

SEQ ID NO: 1003 - protein, 488 aa, Papaver bracteatum
MEIVTLAALIAIVITSFFYLILRDSSPKGLPPGPKPWPIVGNLLQLGEKPHSQFAQLAGTYGDLFTLKLGTQTVVVASTPLAASEILKTHDRVLSGRYVFQSFRIKNHVQNCMVWSDCNETWKSLRKVCRTELFTRKMIESQAEVRECKAMEMVEYLRKHQGNEVKIVEVIFATLVNIFGNLIFSQNIFKLSDENSGSVEMKEQIWRLLELGNSTNPADYFPFLGSLDLLGQRKDVADSLQEIYGVWGPILTEKKLAKQHNTNTTNDFVDLLLDSGLNDQQINAFLMEIFSAGTETSATTIEWALAELIKNPELTANIRSELLSVLGKRTVKESDIPNLPYLQAFVKETLRLHPATPLLLPRRALETCQVLNYTIPKGCQIMVNAWGIGRDPKTWTDPLKFAPERFLSSSIDYKGNDFEFIPYGAGRRICPGMPLATQFISLIVPTLVQNFDLGLPKGMDPSELIMEEKFGLMLEKEPPLYIVPKTRE

SEQ ID NO: 1004 - protein, 509 aa, Papaver bracteatum
MMALENSIRERKRENKIKMDIVTLAALIAIVFTIFFFLILRDSSPKGLPPGPKPWPIVGNLLQLSDKPHSHFAQLAKTYGDLFTIKLGTETIVVASTSIAATEILKTHDRILSGRYVFQSFRVKGQVKLSMTWSDCNDTWNKLRRICKVELFSQKMIESQAEIRESTALEMVEYLKKKEGSEVKMSDVIFGTVMNMFGKSIFSQNIFELGDENSGSLNMKERIRRLMELGNTKNPADYFPFLGSWDLLGQRKEVANCLQRVYDVWGVVLKERKIFNMQHNSKKKNDFVDVLLDAGLEDGQINSLIMEIITGTETSGSTIEWAVAELTKNPQVAAKMRSELLSVVGQRPIKEADIPNMPYLQAFSKETLRLHPPTPLLIPRRALETCKILNYTIPKDCQIMVNAWGIGRDPKTWTDPLKFSPERFLNSSIDFKGNDFGYIPFGAGRRICPGMPVAIQFLSLIVPTLVQNFDWGLPNETDPTQLIMEEKFALTLQKEPPLYIVPRTRDPSA

SEQ ID NO: 1005 - protein, 488 aa, Sanguinaria canadensis
MEIVTVALIAVVISSILYLLFRDSSPKGLPPGPKPWPIVGNLLQLSDKPHAQFAELAQTYGDLFTLRMGTQTVVVASTPSAATEILKTHDRILSGRYVFQSFRVKGHVENSIVWSECNDTWKNLRKVCRTELFTQKMIESQAHVRERKAWEMVEYLKKKEGEEVKIVEVIFGTLVNIFGNLIFSENIFELGDPSSGSVEMKEYLWRMLELGNSTNPADYFPIMGKFDLFGQRKAVAECLQGIYDVWGAMLKERKAAKKAGGSEGKNDFVNILLDSGLNDQQINALLMELFGAGTETSASTIEWAITELTKNPKVTAKIRSELLSVVGQSTVKESDIPNLPYLQAFTKETLRLHPPTPLLLPRRALETCQVMNYTIPKECQIMVNAWAIGRDPKTWTDPLNFSPERFLNSSVDFKGNDFELIPFGGGRRICPGVPLATQFISLIVGTLVQNFDWDLPNGMSPRDLKMEEKFGLTLQKEPPLCIVPKSRA

SEQ ID NO: 1006 - protein, 488 aa, Stylophorum diphyllum
MEIVTVALIAVVISSILYLTFRDTSPKGLPPGPKPWPIVGNLLQLSDKPHAQFAELAQTYGDLFTLRMGTQTVVVASTPKAAAEVLKTHDRILSGRYVFQSFRVKEHVKNSIVWSECNDTWKSLRKVCRTELFTQKMIESQAEVRERKAWEMVEYLKKKQGEEVKIVEVIFGTLVNIFGNLIFSQNIFDLGDPSSGSVELKEHLWRMLELGNSTNPADYFPIMGRFDLFGQRKEVEDCLQGIYDVWGAMLKKRKAAKEAGKSEGRNDFVEILLDSGLNDQQINSLLMELFGAGTETSASTIEWAITELTKNPNVTAKMRSELETVVGHNTVKESDIPNLPYLQAFVKESLRLHPPTPLLLPRRALETCRVLNYTIPKECQIMVNAWAIGRDPKIWTDPLTFSPERFLNSSIDFKGTDFELIPFGGGRRICPGIPLATQFIGLIAATLVQSFEWDLPNGMSPKDLNMEEKFGLTLQKEPPLYIIPKSRD

SEQ ID NO: 1007 - protein, 487 aa, Tinospora cordifolia
MEIITLSIGFIFFIIFIFYFFNNQSSKGLPPGPKPWPIVGNLLQLGEKPHAQFAQLSQEFGDLFTLRLGSQTVVVASSPAAATQILKTHDRILSGRYVFQSFRIDKHVNNSIVWSECNDNWKMLRKVCRTEIFTAKMIESQAHVREAKAMEMVKFLRHREGEVVKIAEVVFGTLVNIFGNLIFSQDVFDLSDPSSGSAEMKEHIWRMLELGNSTNPADYFPIMGKLDLFGQRRAVEECLQQIYDIWGVMLKERRARKGSENTHDFVNVLLEAGLGDQCINSLLMELFAAGTETSSSTIEWAIAELTKNPRITTKLRQELRDVIGEERVKESHIPSLPYLQAFVKETLRLHPATPMLLPRRALETCKVMGYVIPKDCQIMVNAWAIGRDPKVWKDPLTFWPERFLNSSLDYKGNYFEFIPFGGGRRICPGFPLASQFISIIVATLVQNMDWCLPNGTDPSELVMEEKFGLTLQKEPSLLLVFKSRDLK

SEQ ID NO: 1008 - protein, 493 aa, Tinospora cordifolia
MDPTVALILCLVIPVILLISFLYKPRNLPPGPHAWPLVGSLPAVLSSGAPLHITLTNLARTHGPLMLVTLGTQPTVLASTSEAAMEVLKTHDRALSGRHIRMSFRLKEMNKCSLVWSNCTDYWKLLRKIARTEIFSPRMLQIQEHVRERKVGELVEFLRGRKEGKAVKISEFVFGTLLNIIGNVVFSKDVFGFDDEGGDKIGMQSLIRELLMIGASPNVAEFYPILEGLDLQGLKRRCRDRVNRVNKLWETTVMERRKKRSVAEGWESKDMLDVLLDNNFDDVQINVLFLEMFGPGSETSSATIEWVLAELIKNPDKMAKVQKELEKLVGNKGSQVKEAHLPDLPYLQACVKETMRLHPAAPFLLPHRAVETCQVLGYTIPKDYQLLVNAYAIGRDPNTWKDPTSFCPERFLDSSVDFYGNHFEFIPFGSGRRICIGMPLATRTVPLIVASLVHNFDWSLPDGKRPEELVMNEMLSLSLSIDPSLSVVPKTRA

SEQ ID NO: 1009 - protein, 492 aa, Xanthoriza simplicissima
MEVLSIAIVSFLFLLFLFFILRDSRQKNLPPGPRPSPIVGNLLQLGDKPHAEFAKLAQKYGELFSLKLGSQTVVVASSPAAAAEILKTHDKILSGRYVFQSFRVKEHVENSIVWSECNENWKLLRKVCRTELFSPKMIESQAGIREAKAREMVKFLRSKEGEVVKIVEVVFGTLVNIFGNLIFSKDVFDLEDPTGGSAELKEHLWKLLDMGNSTNPADYFPIMGKFDLFGQRRAVAEVLQQIYDVWGVMLKERRGRKVSESNNDFVNVLINAGLDDQKINALLMEMFGAGTETSASTIEWAITELTKKPPVASKIRLELVNVVGDNTVKESDLPHLPYLQAFVKETLRLHPPTPLLLPRRALETCTVMNYTIPKDCQIMVNAWAIGRDPKTWDDPLNFKPERFLSSDVDYKGNDFELIPFGGGRRICPGLPLASQFISLIVATLVQNFEWSLPQGMSTSELSMDEKFGLTLQKDPPLLIVLKARASNDLSFI

SEQ ID NO: 1010 - protein, 497 aa, Xanthoriza simplicissima
MEELIVVLRETNLLYYISLIALPLLFLILKQIKSPSNLPPGPFPWPIVGNILNMGSKPHISLAQLAKSHGPLISLRLGTQLVVVGSSQAAAKEILKTHDRILSARCVPRVIPVYPDQLHLSMAWVECNDQWRYLRTLCRTELFSAKMIESQASVRDKKTNELVEFLANNEGKLVKIGDVVFATVFNMLSNIFVSKDFISLEEESEDGGMKGLLRRFMELGSAPNLADFYTILSGLDLQGITKKSKEMLGQVNGAWGVITKQRRADKGNDVLRQRDFLDSLLDSELDDDQINYLLQELFLAGADTSTSTVEWAMVELIKNPKAMRKVCAELERETSGHIVKESDLPRLPYLHFTVNETLRLHPPAPFLLPHRALETCKVMNYTIPKDCQVLVNAWAIGRDPNTWEDPLSFKPERFLDSGMDLNSGNFKFIPFGAGRRICPGLPMAAKQVTLILACLINCFEWSLPHSMLPSELDMDDKFGITLHKEKPLLLIPKVRKA

SEQ ID NO: 1011 - protein, 486 aa, Xanthoriza simplicissima
MDLQIALFSLIPVILVFILLLKPKYKNLPPGPHPWPFIGSLPILFTNTEVPLHITLANMARTHGPLMILWLGTQPTVMASTAEAAMEILKTHDRIFSARHIRMSFRLKHHIKYSLVWSDCTDYWKLLRKIVRTEIFSPKMLQAQSHVREQKVAELIEFLRSKEGQVVKISQFVFGTLLNILGNVVFSKDVFVYSDESDKGGIQNLIREMLMIGAEPNVAEFYPILEELDLQGLKKKCDDRFIRVMKMWEGTVTERKANRNEESKDMLDVLLANDFNDAQINALFLETFGPGSETSSATIEWVIAELIKSPKEMAKVRKELDEVVGTSTIKESDLPQLPYLQACIKEAMRLHPAAPFLLPRRAAETCEVMGYTIPKGSQVLVNAYAIGRDPKSWKDPTIFRPERFLESDVDFHGAHYQFIPFGSGRRTCVGMPLATRTIPLIVGSLVHTYDLGLPGGKRHQELEMNEMLSLSLAIDPSLCVVPKARA

SEQ ID NO: 1012 - protein, 532 aa, Argemone mexicana
MDNFLLQFQPISIAAFFVALVFLYWSYGRKSNKTLKPRAPEAAGGRPITGHLHLFYGEELTHRKLGSMADKYGPVFNIRFGSHKTLVVSNWEIVKECFTTNDRLFSNRPGTLAIKLMFYDTDSVGYAPYGNYWRELRKISTLKLLSNHRIETLKHLRTSEVESCFKQLYNQWEMKNENRVEVDKLGFASVRMDNWFGDLTFNVVARIVAGKKNFAGGAVNGDIGAQRYKVAMDESFRLMLTFAYSDVIPSLKWLDKLRGLIRDMKRCGSEIDSIVASWVEEHRLKRNSSENNNLDLEEDFIDVCLDIIESSSLPGDDPDTVIKSTCLDMILGGSDTTTVTLTWAISLILNNPHVLKRAKEELNSVVGKDRRVEDSDIPHLTYIHAIIKETMRLYPAGPLIERRTMEDCEVGGYHVPAGTRLLVNVWKMQRDGDVYKDDPLVFRPERFMTSNADVDLKGQHFELIPFGAGRRICPGVSFAVQLMHLVLARLLHEFEITTIPSEPKVDMSESGGLICHKIKPLEVLIKPRLELN

SEQ ID NO: 1013 - protein, 537 aa, Argemone mexicana
MDFSSILLLLNINCFTTSLVTLLVLVMVFLYNNTRFTKPKGNKKMIKPPRLPGARPLLGHLHLFGPGELPHKVLSTMADKYGPAFTIKFGKHTTLVVSDIHTIKECLTTNDILFSNRPSSIAFDLMTYADDSVAFAHYSPYWRELRKISTLKLLSNNRLQSIKQLRLSEVNVCFKELYSLCNNNNKSGAPVLIDMKKWFKEVTTNIVIRVIVGKQNFGSKIVRGEDQEAANYKKIMDELSRLAKLSMFSDYAPLLSLFDYFRGNVSAMKRNGKELNAMLQNWLEEHKRKKNSSISNDDEQDFMDLMLSIIDETKLYGRDADTFIKAISLSMIVGGIDTVVVTLTWILALIMKNPFALKKAQEELDFFVGKERQVEDSDLKNLVYMNAIVKETLRLYPLSCILERDTKEDCEVGGYYVEGGTRLLINAWKLQRDPNVWTDPSEFKPERFLNENADIDVGGQHYELIPFGAGRRVCPGVSFALQFMDLVLARLIHGYELGTLNGEDVDLTEKTEGQINFKATPLDLIVTPRLHPNLYDY

SEQ ID NO: 1014 - protein, 522 aa, Berberis thunbergii
MESIEFLVTLLLSLLALFCAYAWKRKNHTKDSKIKEPPQPAGAWPIIGHLHLISRGGLPHINMGAMADKYGPVFMIRLGVNRAVIVSNTEIVKECFTTNDKFLLNRPVGLALNLMCYNNAMFGFCRYGPYWREIHKIVMLELLSNSRLESLKHVWDSEISTSIEELYQLCQTQNKTHEGPVLVEMKDWFADMALNVSLRMIAGKRYFGASAGGNKDEARKCQKTIRDFFRLVGLFIVSDALPFLRWLDLGGHQKEMKRTFEDLDYMLQGWLDEHKLNRKSGVNGDQDFMDVMLSILDDSKFPDYDVDTVNKATCFQLIIGGTDTTTVTLTWALSLMLNHPHVLKKAQDELDIQVGKHRQVEESDIKNLKYLEAVIKETLRMRPVGPLLGPRETIEDCTIGGYRVRAGTRVMVNAWKVHRDPSVWSNPDDFKPERFLKKDIDFRDQNFEFIPFGSGRRACPGISFAVEVLPMALARLLHGFELKTQLGCKVDMTEHAGLVHAKATPLEVLVSPRLSRELYVSS

SEQ ID NO: 1015 - protein, 514 aa, Berberis thunbergii
GSLALIAIIILSNIVKKSSKSLSSKGGKSAPVVHGAWPVIGHLHLLMGKELPHHALAKLADKYGPAFTLNIGAYQELVISTRDLAKECFTTKDKFFLNRPSNKAMKILTYGEASVGFAPYSPLWVEMRKVTKSNLLSHQRVLMQNRSRASEIDASFKQLYEQCNGKSGASVEMKNWFEEVMLNVVTRNVSGKRSFGTKARLGDAEAVKYKRVIDETARFMGNLVISDMVPSLWWLDNMLGAESAMKKLAIELDSLLGGWVEEHRGKKLSDDEEGDFISLTWEMIDQIQLHGLAPETFIKSMCVGVLLGGSDTTSVALTWALSLMLNNREVLKKAQEELDFHVGKDRKVDDSDLKNLVYLQAIMKETMRIYQVGPLIEREAVEDCEVGGFQIKKGNRILVNLWKLQRDPEVWSDPSEFRPERFLEDKSKVDLKGQNAELMPFGSGRRMCPGVWFGVHSTSLVLARLIQGFEIETPLDAKVDMTETSSVTNYKGSPLEVIARLPGSNLSFMICSYV

SEQ ID NO: 1016 - protein, 545 aa, Corydalis chelanthifolia
MTPSISQPFELLLLLMTMESLLLQWQPTSIAVLLLAITIFLYTFTKSPPKTHKKLAPDATGGRPLMGHLHLFNSNELTHRTLGSMADKYGPAFNIRFGSHKTLVVSTWEIVKECFTTNDRSFSNRPGTLYIKLMFYNEDSVGYAPYGAYWRDLRKLSTLKLLSNHRLESLKHLRVSEMNECFKQLYEICNKGSKSVAVRMDNWFGDLTFNVVARIVAGKRNFASISNDVGAMRYKNAMDEAFRLMTVFSFSDVIPSLGWLDNLRGLVGDMKKAGKEIDSVVSGWIEEHREKRKRRSSGGNNRDGELEEEDFIDITLSILETSSLPGDDPDMTIKSTCLDMILGGSDTTTVTMTWALSLLLNNAHALKRAREELDLHVGRDRQVEDSDINNLVYIQAIIKETMRLYPAGPLIERMTKEDCEVGGFHIPAGTRLLVNLWKMQRDPNVWEDPLEFRPERFLTNNAEIDLKGQHFELIPFGTGRRICPGVSFALQLMHLALARLLHSFEVASPMDAKIDMTETAGLISHKVIPLEVLMTPRLDSKLYDY

SEQ ID NO: 1017 - protein, 523 aa, Corydalis chelanthifolia
THTTEKNLPPEVPGALPVIGHLHKLGGRKGLLPYHVLGAMADKYGPAFTFQFGSNRTLVISNWEMVKECFTSTNDKLFAYRPTALFNKEVFCSDHSFGFGPYGPFWREMRKVCSLHLLSNYRLELLKHSRKSEMDECFKELYQLWSASNISKDKQPAVLVVEMKKWFEDAMFNVASRVVVGKGSLKSHEKAGGSDNEVARNKYKKGMDEARRHMGTFVISDRIPFLWWIDYLRGIHSSMKRTAKDLHAIVETWLEEHRLHCHKRRVLQLDANHEVEDMAKEEEKDFMDVLLTMADEGAIKIFDHDLDTVIKANCLDMVIAGTDTPTVMLTWTLSLLLNNPDVLKRVRDELDLHVGKERQVEESDVKNLVYLQAVFKETLRLYPAVPLNERLTMEDCNVGGYDIPAGTRLLINIWKVQRDPNVWQDPSEFRPERFLSKEKSTIDVRGLDFELIPFGTGRRMCPGISFSLQLMHLGLARLIHGFELATPMDLDVDMSANPGAFNYKSTDLQVLVSPRFHSKFYGC

SEQ ID NO: 1018 - protein, 536 aa, Corydalis chelanthifolia
MDFLALQWFPASLTALLALAVLYNFWTKQRTYKNGKTSTKQAPVAAGAWPVLGHLHLFGGGELPHKMLATMADKYGPAFTMKFGTHQTLVVSNTKIVKECFTTNDTLFANRPSTTAFHLMTYDNESVAFTPYGPFWRELRKISTLKLLSNHRLQAIKDVRASEVNVCFRELYSQWRINKSEPETSDHQGPILVDMKKWFEEVSDNVVLRVIAGKQNFGSKIVHGDKEALHYKKIMDEILRLAAVSMLSDVAPLLGWLDMFQGHLSAMKRNAKEVDTMLCNWLEEHRTKRLSSDHDGVEQDFIDVMLSIVEENKFSGHDNDTVIKATVLAMIMGGTDTTAVSLTWIVSLLMNNRHVLRRAQDELDLHVGKDRQVDDSDLKNLVYLNAIVKETMRLYPLGALLERETKEDCEVGGFHVKGGTRLLVNVWKLQRDPSFWTDPTEFKPERFLADKANIDVGGQHFELLPFGAGRRVCPGVSFALQFMHLVLARLLHGFDLATPMNADVDLTESTEGHVNQKASPLNLLVTPRLHSKLYEY

SEQ ID NO: 1019 - protein, 543 aa, Corydalis chelanthifolia
MEYTFSSASLFSSSSLQQWLSTLLLLISSITISLYLTRRGKSSPPMVPGAWPLIGHLHLLGGNDPLHIVLGTMADKYGHTFAMLFGKHPSLVVSSSDIVKECFTSTNDKLFSHRHVPTGVKYMFYNNDSFGFAPYGPYWREMRKMNSLSLFSHHRVEMLNRIRTSQINIWFKNLYEMCTKEKSTSTSSDGVVVEMKSWFDEMFFNVLVNMIVKPINDDEELVKKYREVATEAGRLLSSMAVSDMVPSLGWLDHLFGIVGKMKKTAKDMDAILTTWLEQHKIKSQQLRRSNGGEGAADQTEEEEKEGKGLIGDLLSMQESALFGHDRDTVIKSACQALIMAGSDSTSATLTWVLSLLLNHRDALRKAREELDQVVGKDRQVDDSDIKDLVYLQAILKETMRLYPAAPILERLAVEDCIVGGFHVQAGTTLFVNVSKLQRDPNLWTDPLEFKPERFLTGCNADVDLKGQDYELVPFGSGRRSCPAVSFAVRVMLLVLARFIHSFEVKTREEDGILDMTESSGHTNCRSSPLEVLISPRLDSKIYC

SEQ ID NO: 1020 - protein, 528 aa, Corydalis chelanthifolia
MEYYSSLPFLQQWPLSSISSSPTSIATTLLIVACFTIVFLYINTSSKSNNNLKSPPKLPGAWPFMGHLHLLGGNQPAHVSLANIAEKYKSTPFMIRMGQHSTLVVSSVDLVKECFNNTNDKLFSNRSIARGIRDMFYDMESFGFAPYGYYWRELRKVSALTLFSTHRVDSVIQIKTPQIDGWFKKLYEQCTNTKGGIVEIKSWLDEMMFDVLVKMLVEPKDEGSVEKYRHVAGEALEVLGNMSIYDLVPSLGWLDHFTGLVKKYKVTGKKMDTILNSWLEDHRGEKVAEEHKGLIGKLLSMKEGSKLLGHDGDTAIKSTVQVLILGAGDSAGATLTWAISLLLNHPHIMEKLRKELDAAVGKDRQIEDSDVKKFTYLLAILKETMRLYPVTTLLQRETMEDCAIGGYHVAAGTRLMVNVWQVQRDPNAWSDPLEFKPERFLTECAHVDFSGQYSELIPFGTGRRICPALTLSVRLMLLTLARIIHSFDVKIPNGASSVDMATSVGFVNLRLTPLEVELSPRLDSKIYG

SEQ ID NO: 1021 - protein, 537 aa, Corydalis chelanthifolia
MDSSLLQWYTTASMAALLALAFFYKLWSKPRTSKNGKSTLQAPVAAGAWPVLGHLHLFSGGELPHKMLAAMADKYGPAFTMKFGTHRTLVVSDTKIVKECFTTNDTLFANRPSTMAFHLMTYDNESVAFTPYGQFWRELRKISTLKLLSNHRLQAIKDVRASEVNFCFRTLYNQWRINKSETIGTGDHQGPILVDMKKWFEEVSNNVVIRVIVGKHNFGSKIARGKGEALHYKKVMDEVLRLAAVSMLSDVAPLLGWFDHLQGHVSAMKRNAKEVDTLLCSWMEEHRKKRTSNGSNGVEQDFIDVMLSIVEENKFSGHDSDTVIKATVLAMIMGGTDTSAVSLTWIVSLLMNNRHVLRRAQEELDTHVGKDRQVDDSDLKNLVYLNAIVKETMRLYPLGALLERETKEDCEVGGFHVKAGTRLLVNVWKLQRDPNFWIDPTEFKPERFLTDNANIDVGGQHFELLPFGAGRRVCPGVSFALQFMHLVLARLIHGFELDTPMNANVDMTESTEGHVNHKASALDLLITPRLRSTLYDY

SEQ ID NO: 1022 - protein, 571 aa, Corydalis chelanthifolia
MFKSVPSAQAILHKLSFIHQYFLLSQTNMDSLLFQWFPASMAALVAFAFLYKLWSAPKITKNGKTSTKQAPIAAGAWPVLGHLHLFGGGELPHKMLAGMAEKYGPAFTMKFGMHRTLVVSDTKIVKECFTTHDTLFANRPSTTAFHLMTYDQESVAFTPYGPFWRELRKISTLKLLSNHRLQAIKDVRTSEVNVCFRGLYNIWQTNKNEQGGTVSDHPRPVLIDMKKWFEEVSNNVVIRVIAGKQNFGSKIVRGEEEAVKYKKIMDEVLRLAAVSMLSDVAPLLGWLDLFQGNLSAMKRNAKEVDNMLNAWVEEHRRKRLAHSAKVEATHVEQDFVDVMLSIMEENKLSSVHDDDTVIKATVLAMIMGGTDTTAVSLTWTVSLLMNHRYVLKKAQEEIDQHVGKERQVEDSDLKNLVYLNAIVKETMRMYPLGALLERETKEDCEVGGFHVKGGTRLLVNVWKLQRDPNVWIDPTEFKPERFLAENANIDVGGQHFELLPFGAGRRVCPGVSFALQFMHLVLARLIHGFELETPMNADVDLTESTEGHVNHKASPLDLLIAPRLNSKLYEL

SEQ ID NO: 1023 - protein, 533 aa, Corydalis chelanthifolia
MDSLFVLLQWFSASLAAVLALAFLYNLWVKPRISDGKGNKGSTKQAPVAAGAWPVLGHLHLFGGSELPHKMLAAMADKYGPAFTMKFGTHRTLVVSNTQIVKECFTTNDTHFSNRPSTTAFHLMTYDNDSVAFTPYGPFWRELRKISTLKLLSNHRLQAIKDVRVSEVNVCFKDLYNQWKTNQNQRPVLVDMKKWFEEVSNNVVIRVIVGKQNFGSKIVRGEEEAVKYKKIMDEILRLAAVPMLSDMAPLLGWLDLFQAHKSAMKRNAKEVDNMLESWLEEHKRKRLSGVNGAEEEDFMDVMLSIMEENKFTGRDSNTVVKSTVLAMIMGGTDTTAVSLTWIFSLLMNNRHALKKAQEELDMHVGKDRQVEDSDLKNLVYLNAIVKETMRMYPLGALLERETKEDCEVGGYHVRAGTRLLVNVWKLQRDPSFWTDPTEFKPERFLTENAKTDVGGQHFELLPFGAGRRVCPGVSFALQFMHLVIARLIHGFELGTPMDADVDLTESTEGHVNHKATPLDLLIAPRLDSKVYDY

SEQ ID NO: 1024 - protein, 530 aa, Chelidonium majus
MRSNYLKPTTTTIEDKSKNKISRKKPIAAKPPPEALGAWPVIGHFLLFTGKGLTHVTLGDMADKYGPAFLIRFGSHRTLVVSSWEMMKECFSAPNDKIFSNRESNLLWIKSMFYGSNSYGFSPYGPYWKELRKISTQKLLSHHRLDAMKHLQMVEVDASFKQIYNLCNKNGGSPSPSSINTTALVNMDEWLSHLMFNVIARMVSGYQSDDVGTGATSTGERFKVSMDETMRLMAIFAVSDLVPWLACVDRLRGLTRKMNRCGKDLDSIIGRLIEEHRQKRRLCRNNKGSKNEDGGHDDDQDFIDICLSIMEQSQLPGDNPEIAIKSIVLDMIFAGSHTTTLAMTWTLSLLLNHRHMLKKAKEEIDAHVGNERQVDDSDIHNLVYIQAIIKESMRLYPPSPLFERMTMEDCEVGGFHIPAGTRLFVNVWKMQRDPTVWEDPLEFRPERFLTSKREIDVKGQHYELIPFGAGRRICPGASFTLQVLHLVLARLIHGFEMTTPMDVKVDMASSAGLFSNKMTPLEVLITPRTA

SEQ ID NO: 1025 - protein, 557 aa, Chelidonium majus
MKILQEFHQLTISNIVLLLLISFIFFSLSAWFIESTNYYYSSKKKKSKKTPPPEASGAWPVIGHLHQFKPDDLPHEALGDMADKYGPVFIVRFGSYRKLVVSNSEMVKECFTAANDRSFSNRPAVLGIRIMLYNTITYAFAPYGPYWRELRRISSQNLLSNHRVDMVKHLHVDEVNTLFKQLYELCNKNGGRPPTGTNTSTSAALVNMDDWLSNIMFNVIARIVNGNNKSINNERTGAINEKRYKTAMDEARRLVAIFAVSDSVPWLGWLDRVRGLIRGMNLCGKELDSIIEDIIDEHRQKRRLCTSKLGSSGDDDADNSNLEEEDNFIDACLSIEEQSQLPGENPEIVIKALILDMFAGGSDGPHFVLTWTLALLLNHPHVLKKAREEVDAHVANDRHVDVSDISNLVYIQAILKESMRLYPPNALIERMTTEDCEVGGYHIPAGTYLLVNVWKVQRDPTVWQDPSEFRPERFLLTNTKTEMEYEHIPFGAGRRRCPGMRFALQVMHLVLARLIHEFEITTPVDVIKVDMTATNGLFNHKAVPLEVLLTPRTLIRG

SEQ ID NO: 1026 - protein, 541 aa, Chelidonium majus
MDYSVLLQYGWFAPSMAALLALAFLYNLFLASSPKATSKRTISTKKPPMAAGAWPILGHLHLFKEGELPHQMLKSMADKYGPAFLMKFGQHRSLVVSDYRIVKECFTTNDTHFCNRPSTTAFDVMTYANESVAFTEYSPYWRELRKISTLKLLSNNRLQAIKNLREEEVNVSFKGLYDSWKNKNNKSTGSVGDERAPVLVDMKKWFEEVSNNVVIRVIVGKCNFGTKIVQGEKEGVEYKTIMDELLRLASLSLLSDFAPILGLLDFFQGHVRTMKRNGKKLDVLLQRWLEEHKRKKSTPEDEQDFMDVMLSVIEESKLSGYDADTVIKATCLAMIMGGTDTSAVSLTWIVSLLMNNRHALKKAREELDAQVGKDRQVEDSDLKNLVYLNAIVKETMRLYPLGTLLERETKEDCEVGGFHLEGGTRLLVNVWMVQRDPSVWTDPTKFTPERFLTEKADIDVWGGNFELIPFGAGRRVCPGVSFALQFLNLVLARLIHGYELGTPDDADVDLTESPEGHLNHKASPLELLLTPRLSNPKLYDY

SEQ ID NO: 1027 - protein, 537 aa, Chelidonium majus
MEFLSLEPQLISIFVLLLASSIFLYNLLKNHGRKSKTSKPPAPVASGGWPIMGHLHLFNGSELTHQTLGSMADKYGPAFNIQLGSHQTLVVSSWEIVKECFTTNDRFFSNRPGSLAIKLMFYDADSVGYAPYGAYWRDLRKISTLKLLSNHRVETLKHLRTSEAESCFKQLYNQWKNNKVGGDDDEFAIVRMDNWFGDLTFNVVARIVAGKKNFAGGATSGDVGAKRYKEAMDEAFRLMTIFAFSDVVPSLGWLDKLRGLVGGMKRCGAEIDSIVGGWVDEHRLKRASRKGGDHNDLDLEQDFIDVCLEIMEHSTLPGDDPEIVIKSTCLDMILGGSDTTTVTLTWALSLLLNNPHVLKRAREELDTHVGKDRQVDDSDMSNLVYIQAIIKETMRLYPAGPLIERRTSEDCEVSGFHVPAGTRLMVNLWKMQRDGSVYKEDPLEFRPERFLTSNADVDLKGQNYELIPFGAGRRICPGVSFAVQLMHLVLARLVHGFEMKTAGGAKVDMTESAGLISHKVTPLQVLLKPRLAIQQAL

SEQ ID NO: 1028 - protein, 550 aa, Chelidonium majus
MDSMNLFQQAIAVGTLVIFLYYLWKWTSIIFTRTHQAAPPEPAGAWPIIGHLHLLAGGANQLVYHILGSMADKYGPIFTVRLGMRRALIVSNSELAKECFTTNDRIFSTRPSSVAIKLMGYDSAMFGFAPYGPYWREMRKIAVTELLSNRRLEILKNIRISEINMSIKDLYQLWVENKNSGVDGGGDGGEVVVGSPVLVEMKRWFEDVSFNVVVRMVAGKRYFGRRVESDDREEEEARRWQKAMNDFMHLVGIFVVSDAIPFLGFLDFQGYEKEMKKTAVEIDYVMGRWVEEHQRRKLERVAGGSDDQQEDFIDVMLSILKDGDQFYGYDPDTVIKSSCLSLVLGGSDTISVTLTWTVSLLLNNRNVLEKAQSELDIHVGRGRQVDESDINNLKYLQAIVKETMRLYPAGPLSAPREAMEDCTIAGFHVPKGTQLMLNLWKLHRDPRVWSDPLEFKPERFLTTGTHGDVDVKGQHFELLPFGAGRRICPGISYALQVLHLTLARLLHSFHLSTPYDIPVDMTESSGLSCPKATPLDVLLTPRLPSELYVS

SEQ ID NO: 1029 - protein, 561 aa, Chelidonium majus
MDLFIFFSRFQYIVGLLAFLTFFYYLWRVSITGTRIKTNQNIMNGTNMMAPEAAGAWPIVGHLPQLVGPQPLFKILGDMADKYGSIFMVRFGMHPTLVVSSWEMAKECFTTNDKFLASRPTSAGGKYLTYDFAMFGFSFYGPYWREIRKISTLELLSHRRVELLKHVPYTEIGGSIKQLYKLWMETQNQNKQRDDHQVKVDMSQVFGYLTLNTVLKLVVGKGLFNNNDMNHEQEEGRKLHETVLEFFKLAGVSVASDALPFLGWLDVDGQKRSMKRIAKEMDLIAERWLQEHRQKRLTSNNKASSGHDDFMSVLLSILDDDSNFFNYNRDTVIKATSLNLILAASDTTSVSLTWVLSLLVTNPGALKKVQDELDTKVGRNRHVEERDIEKLVYLQATVKETLRMYPAGPLSVPHEATQDCTVGGYQVTAGTRLVVNVWKLQRDPRVWPNPSEFKPERFLPDGCEVGCGEAANMDFRGQHFEYIPFGSGRRMCPGIDFAIQIIHMTLACLLHAFEFQVPSSLDKHLVPAVIDMSEGSGLTMPKVTPLEVLLNPRLPLPLYEL

SEQ ID NO: 1030 - protein, 522 aa, Cissampelos mucronata
MEAMGEYFQLISWTVFSALITIYFIFSRKTNGKKKAPEPGGAWPIIGHLHLFGAHDLLYRKLGAMADKLGPVFMIRFGMHRAVVVSNYEVAKECFTVNDKILASRPRIIASKLMGYNHAAVGLSPYGPYWREARKIATLELLSNHRLQLLKHIRISEIDMWIKELKEFCMKSSSDGPVLVQLDGWFNALTLNIMVRNIAGKRYCGGAEAFEDEESQRWKKVSRELMFLFGVFMVPDAFPVLEGIDVQGFERAMKRVGKEMDFFLSRWLEEHRRKKIELSEKGNEVNDQGAQDFIDVMLNTIKDAKIFEHDADTMIKATCMALVVAGNDTTMITLSWAVSLLLNNRGVLEKAQEELSNQIGKNRHVEEGDIESLPYLHAIVKETFRLYPAAPLSLPHEAMEDCTIAGFHVPAGTRLITNIWKLHKDPNIWPDPLEFKPERFLTTHAHVDFKGQHFEFIPFGSGRRMCPGSSLAISVLHLTLARLLHEFELKTPDDAPVDMTEGPGITLMRANPLHVLINPRHD

SEQ ID NO: 1031 - protein, 534 aa, Cissampelos mucronata
MSSPIQQLLLSLTSINGGTIISAVIISLLLILTLHRLLKPINSNKTKHPPRASGAWPVMGHLHKLRGPDLPHRTLSSMADQYGPIFTINLGPTTALVISDPAVAKECFTTNDLTFSSRPTTLATTLMCYNNTMFGFAPYGPYWREVRKVVMAQLLSTRRLESLKNIWASEIDRWVKGLAQKAQSGSHGVVEVEMGDWLARLTMNIGLRLVVGKSCGEMGSEESERCLGAMREYPELLGRFALEDALPWLGRFDLQGHQREMRRAARVLDEILDGWLDEHKRNRSGLSGGDDHRDQDFMDVMLSVLEQDQDSSLSDHDADMINKSTCLNLILGMADTTMVALTWAISLLLNNKTSLKKAQEELQAQVGNERHVDESDVKNLVYLQSIIKEVLRLYPPEPLSGPREALEDCEVAGYHVPRGTRLIANLWKIHRDSSTWQDSMEFRPERFLTAHEHVDVWGQHFEFMPFGSGRRSCPGVSFEVRVLPLILARLIHAFEMTTRGDVPVDMSERPGLVISKASPLEVMISPRLPLHLFE

SEQ ID NO: 1032 - protein, 536 aa, Cissampelos mucronata
MEFHLLLQAVAATLVTFFLYELWALRKKFSRLTKTPSSKALLKAKCAPEPPGAWPIIGHLPLLVSAKQPHRAFAALAEKYGPAFMLRMGMSPMLIVSTKEVAKECYTANDHVFATRPVTTAGKLMAYDHSVMGFTPFGTYWREIRKIATVELFSARRIGMLKPVRQSEVSLWMKGLHEKWVHNGNSSVSVELKSQLEELTFNLLTQMVAGKRYYGSNVAKVDEKMAGLFRHAVQQFNYHLGNSEMYDALPFMAWLDFKGDAKAMKKTQKDLDFIMQTWLDEHRLKADQMRGDAINNTRDFLDVLVMMEKTGQFSSAIKDRDTTIKALALTQLVAGVDSMANTMVWVLALLMNNPEMLAKAQDELDNNVGKDRLVEESDIPNLKYLQALLKETLRMYPVGPLLVPHEATEDCHVAGYFVPRGTGLFINAWTIQRDPNVWAEPNCFNPERFLTTHAEMDVKGQNHELLPFGSGRRSCPGVGLALQVMHLTLARILQAFELKTQSGVGIDLEECSGILLSMMHPLQVMMAPRLPSELYD

SEQ ID NO: 1033 - protein, 524 aa, Eschscholzia californica
MDSLILTNWFPISIASVLTLVFLYKVLLSSRTLKDKKIKTSPMANGAWPILGHLHLFGSGELPHKMLATMADKYGSAFRMKFGKHTTLVVSDTRIVKECFTTNDTLFSNRPSTKAFQLMTYDNESVAFTPYGPYWRELRKISTLKLLSNHRLQAIKDVRASEVNVCFKSLYDQCKNPSGAPILIDMKKWFEEVSNNVVMRVIVGRQNFGSKIVQGEEEAIHYKKVMDELLRLASLSMFSDFAPLLGFLDIFQGNLSAMKQNAKKVDAILENWLEEHRKKKNSVAESEQDFMDVMLSIANESKLSGHDADTVIKATCLAMIMGGTDTTAVSLTWIISLLMNNRHALKKAREELDALVGKDRQVEDSDLKNLVYMNAIVKETMRMYPLGTLLERDTKEDCEIGGFHVKGGTRLLVNVWKLQRDPNVWVDPTEFRPERFLTENADIDVGGQHFELLPFGAGRRVCPGVSFALQFMHLVLARLIHGYDLNTLNEENVDLTESPEGHVNHKASPLDLILTPRLHYKLYE

SEQ ID NO: 1034 - protein, 532 aa, Eschscholzia californica
MDTASSISLLLPWAVVVPSIATLLALLLFLFITSPKTPKRKTSSKPPPTVLPGAWPILGHLHLFKEGESPHHMLKNLADKYGPAFVMKFGQHRSLVVSNTKIVKECFTTNDTLFSNRPSTTAFDLMTYAHDSVAFTPYSPYWRELRKISTLKLLSNNRLKAIKKLRGEEVDVCFRGLYGLWKNKTKNGAPVLVDMKKWFEEVANNVVIRVIVGKLSFGTKIVDGEEEAVEYKTVMDELLRLASLSLLSDMAPILGWLDFFQGSVRKMKQTGKRLDVLLEKWLGEHREKKNLVGEDEQDFMDVMLSIVEESKLSGHEADAVIKATCLAMIMGGTDTTAVTLTWIISLLMNNRHALEKAREELETHVGKDRQVEDTDLQNLVYLSAIVKETMRLYPLGTLLERETKEDCEVGGFHIQGGTRLLVNIWMVQRDPTVWNDPSAFKPERFLTDKSEIDVGGQHFELIPFGAGRRVCPAVSFALQFLHLVLARLIHGYDLGTPSNVEVDLTESLEGHVNHKASPLELLLTPRLNPKLY

SEQ ID NO: 1035 - protein, 548 aa, Eschscholzia californica
MESEIQYQTATMASILSTNLILSSIFTAFLLYFLLKMSPFRSSKNKSRKQAPKPTGSWPIIGHLLHLQGPNLPHINLAALADKYGSVFSFRIGLRPALVVSSWEIAKECLTTNDRVFVSRPPLIAMKHMGYDHALFGFSPYGPYWRELRKLVNQELLSNTRIELIKHVWDTEINTFINDLYEVWAMKSNEGGGDVVVEMKQCLYDFTLNLTLKILTGKRYFGGGGSEELREEAGRCQKAVRNFLRLVGTFTAQDVIPFLEGWLDLGGHEKEMKITGKELDSLLQKWLEEHKVKKSSAGEEGQENRGGDEEDFMGVMLTKLRDHEKLLSYYDADTINKATCLTVILGGSDTTMMTLVWALALLVNHPHVMKKLQDELDTHVSKERQVEESDIKNLAYLQSVMKETMRRYPGTPLYVRESIEDCTIAGYDVPTGTRLVVNAWKIQHDPQVWSNPFEFNPERFLTTHKDIDVRGQNFELIPFGAGRRMCPGASLGLQVVHLTLARLVHGFEFKTPDGEPMDMTESIGLTNLKATPLEIMLTPRLSSKLYVC

SEQ ID NO: 1036 - protein, 554 aa, Eschscholzia californica
MGLSFDLSSHNFLQFSNPTILIGLFGLLVYLLLVNLRKRISRKNEAPEVEGGWPIIGHLHHFMGGKNKLLHVAFGAWADKYGPVYTLRMGLNKVLVVNSAEVAKECSTTNDMLFMARPYRIASEIMGYGYAMFPIAPYGPFYLKMRKMVTQELLSNSRVDSLKHVWGSEIKNAIQELHKKVLSTKGGGPISMDMKGWVSNLTFRTAMKVICGGVGVDGGGGGGGATSPATSIGEHNYDEVGSFQKALKEFFVLLGEIRISDVIPFLGWLDMRTGYVEKMKDNGKFLDNLMEEMLEEHKRKRRSLTEEEEKDGGYVEQDFMDVMISKLNDPKLLSYYDADTINKSTCLTLILSGSETTMVSIVWALALLVSHPHVLKKAQDELDTLVGRERQVDESDIKDLVYLQAVVKEALRLFPPAPLSTPRVATEDCVVSGYHVPAGTQLFVNTWKIQRNPEVWPEPSEFRPERFFTTHKDFDVRGLHYDLHPFGSGRRACPGAGFALQVVHLTLASLLHGFEIKNPSDEPIDMTESPGVTNLKATPLKVLLTPRLFSKEVY

SEQ ID NO: 1037 - protein, 561 aa, Eschscholzia californica
MEKPILLQLQPGILGLLALMCFLYYVIKVSLSTRNCNQLVRHPPEAAGSWPIVGHLPQLVGSGKPLFRVLGDMADKFGPIFMVRFGVHPTLVVSSWEMAKECFTSNDKFLASRPPSAASIYMAYDHAMLGFSSYGPYWREIRKISTLHLLSHRRLELLKHVPHLEIHNFIKGLYGIWKDHQKQQQQPTARDDQDSVMLEMSQLFGYLTLNIVLSLVVGKRVCNYHADGHLDDGEEAGQGQKLHQTITDFFKLSGVSVASDALPFLGLFDLDGQKKIMKRVAKEMDFVAERWLQDKKSSLLLSSKSNNKQNEAGEGDVDDFMDVLMSTLPDDDDSFFTKYSRDTVIKANSLSMVVAGSDTTSVSLTWALSLLLNNIQVLRKAQDELDTKVGRDRHVEEKDIDNLVYLQAIVKETLRMYPAGPLSVPHEAIEDCNVGGYHIKTGTRLLVNIWKLQRDPRVWSNPSEFRPERFLDNQSNGTLLDFRGQHFEYIPFGSGRRMCPGVNLATPILHMTLARLLQSFDLTTPSSSPVDMTEGSGLTMPKVTPLKVLLTPRLPLPLYDY

SEQ ID NO: 1038 - protein, 565 aa, Eschscholzia californica
MNLSSKLMGSFDLFSLNFLQFSKPASMVIIGICSFLVYFSLLNLVRRVLAPSCTMKNGKTEPPEVENGWPIIGHLHHFMGKKNKLIHEIFGDMADKYGPTFTLRMGLTKVLVVSSAEVAKECLTTNDLVFIGRPPRVANSLLGYSFAMFPFSPYGTYYSQMRKIVTHELLSTSRVESLKHVWNSEINKAIQELHHKVVSVGGGSPVLIEFKRWFSDLTLRTTVKLICGKQYFGTDGATQASMTINGGGDDDEAGKFQEALREFFCLLGKFRVSDVIPFLGWLDFGTGYKEKKNRMFIDSLMEEWLEEHKMKRRLLNEADKKESRIEQDFMDVMISKLDDPNLLSHYDADTINKATCLTLILGGSDTTMVSLVWALTLLMNHPHVLKKVQDELDFHVGRERQVEESDMKNLVYLHAVMKEAMRLNPAGTLSAPRMSTKDCTVSGYHIPAGTHLFMNTWKIQRDPNAWVEPTEFRPERFLTTHKDFDLRGQNFELLPFGSGRRSCLGANFALQVLRQTLARLLHGFDLKTPSDEPVDMTGSAGLINMKATPLEVLVTPRLFSSELYG

SEQ ID NO: 1039 - protein, 550 aa, Eschscholzia californica
MNLLIFFQFLLQFQVLVGLSVLLAFSYYLWVSKNPKINKFKGKGALLAPQAAGAWPIVGHLPQLVGPKPLFRILGAMADNYGPIFMLRFGVHPTVVVSSWEMTKECFTTNDRHLASRPSNAASQYLIYEVYALFGFSLYGSSYWRDARKIATLELLSHRRLELLKHVPYTEIDTCIKQLHRLWTKNNKNQNNPELKVEMNQFFTDLTMNVILKLVVGKRFFNVDDAADHEKEEARKIQGTIFEFFKLTEGSVSAGALPLLNWLDLNGQKRAMKRTAKKMDSIAEKLLDEHRQKRLSKEGVKGTHDHNDFMDVLLSILDADQGDYSHHPFNYSRDHVIKATTLSMILSSMSISVSLSWALSLLLNNRHVLKKAQDELDMNVGKDRQVEEGDIKNLVYLQAIVKETFRMYPANPLLLPHEAIEDCKIGGFNVPAGTRVVVNAWKLQHDPRVWSNPSEFKPERFLNDQAAKVVDVRGQNFEYLPFGSGRRVCPGISFSLQTIHMSLARLVQAFELGTPSNERIDMTEGSGLTMPKTTPLHVLLNPRLPLPLYE

SEQ ID NO: 1040 - protein, 532 aa, Eschscholzia californica
MEFHFPLMEQFQPFFIFALLLASFIFLYKLFNFGNRITKNGKPTAPEASGGRLIMGHLHLFNGTELTHRTLGSMADKYGPAFNIRFGSHKTLVVSSWKIIKECFTTNDRFFSNRPGSLAIKLMFYDADSVGYAPYGSYWRELRKISTLKLLSNHRLETLKHLRTSEVDSCFNQLMNSWAENKNRGDSDFAPVRMDDWFGDLTFNVVARIVAGKKNFAGGAARGDAGAQRYKSAMDEAFRLMTIFAYSDVIPSLGWLDKLRGLVGDMKRCGSEIDSVVESWVDEHRLKRRVSKKGGELDLEQDFIDVCLDIMEHSSLPGDDPEIVIKSTCLDMILGGSDTTTVTLTWALSLLLNHPQVLKRAKEELDSQVGKERQVEDSDIPNLPLIQAIIKETMRLYPAGPLIERRTMEDCEVAGFHVPAGTRLLVNLWKMQRDKEVWSEEPLEFRPERFLTSNTEVDLKGQHYELIPFGAGRRICPGVSFAVQLMHLVLARLLHGFEMTTPMGEKVDMTESAGLISHKITPLEVLIKPLRV

SEQ ID NO: 1041 - protein, 510 aa, Eschscholzia californica
MDSFLLAYWVPISVASIIAFVFLYNLFSSRTLQNKKIRTAPMATGAWPILGHLHLFGSGELPHKMLAAMADKYGSAFRMKFGKHTTLVVSDTRIVKECFTTNDTLFSNRPSTKAFQLMTYDNESVAFTPYGPYWREIRKISTLKLLSNHRLQAIKDVRASEVNVCFKTLYDQCKNPSGSAPILIDMKKWFEEVSNNVVMRVIVGRQNFGSKIVQGEEEAIHYKKVMDELLRLASLSMFSDFAPLLGFVDIFQGNLSAMKRNAKKVDAILENWLEEHRKKKNSVAESQQDFMDVMLSIVEESKLSGHDADAVIKATCLAMIMGGTDTTAVSLTWIISLLMNNRHALKKAREELDALVGKDRQVEDSDLKNLVYMNAIVKETMRMYPLGTLLERETKEDCEIDGFHVKGGTRLLVNVWKLQRDPNVWVDPTEFRPERFLTENADIDVGGQHFELLPFGAGRRVCPGVSFALQLHAFSTCSPHPWIRFEYSKRRKCGSDGEPRRTCEPQSIAS

SEQ ID NO: 1042 - protein, 534 aa, Glaucium flavum
MEFLSLQLQPVSIFALLVASIFLYNFLIHGKKSNNKKTTKPPAPEASGGWPIMGHLHLFNENELTHRTLGSMADKYGPAFNIRFGSHPTLVVSSWDIVKECFTTNDRFFSNRPGSLAIKLMFYDADSVGYAPYGAYWRDLRKISTLKLLSNHRLETLKHLRTSEVESCFKELYNQWRNNKTGGGGDGFAPVRMDNWFGDLTFNVVARIVAGKKNFAGGAASGDAGAQRYKEAMDEAFRLMTIFAFSDVVPALGWLDKLRGLVGGMKRCGAEIDSIVAGWVDEHRLKRSSGKGSDADLEQDFIDVCLEIMEHSTLPGDDPEVVIKSTCLDMILGGSDTTTVTLTWALSLLLNNPHVLKRAREELDTNVGKDRQVDDSDIPNLVYIQAIIKETMRLYPAGPLIERRTSEDCEVGGFHVPAGTRLLVNLWKMQRDGSVYKEDPLEFSPERFLTSNADVDLKGQNYELIPFGAGRRICPGVSFAVQLMHLVLARLIHGFEMKTPEGGKVDMTESAGLISHKVTPLEVLLKPRLAIQHS

SEQ ID NO: 1043 - protein, 561 aa, Glaucium flavum
MHAKLTLIKKMEFTIINSLEIQPIISTFALLTFSILLYKILLNHGRENKNNKPKTSSSSSSIPEVAGAWPIMGHLHLFNGDELMHHKLGSMAEKYGQAFYIRFGSHKAVVVSNWEMVKTCFTTNNQIFLNRPPMLAINLLFFPTDSLSYIPYGDHWRELRKFSNQKLLSNHRIETQKNLRKLEVDYCFKQLCNQSSKYFIINNMDDQDSKFALVRMDTWFDDVTLNVLARIIAGKKKFISGGATSSGDDDNAEARRYMEALDEGLRLMTSFTFSDVLPWLGWLDNLRGLAGKMKRCGAELDSVFAGWVEEHRVKRGSRKDGDDADLEQDFIDLCWESLEQVPGNDPAKIIKLICMEMILNGSGATAVTLTWTVSLLLNNPDVLKRAREELDTHVGSHRQVDESDIPNLVYIQAIIKEGMRLYPPGPFLERSTTEDFEIDGVHVPAGTRLWVNLWKMHRDESMYQEPLEFKPERFLNSNSDVDLKGQSYQLLPFGAGRRICPGVSFALPLMHLTLARLIHGFEMKLPVGVEKVDMTENGGIINRKATHLDVLLKPRLIAQQA

SEQ ID NO: 1044 - protein, 536 aa, Glaucium flavum
MDTLSIQWIVPSIATLLALVFLYNLIFTSKKTTKTNNTRKAPMASGAWPVLGHLHLFGTGELPHKMLATMAENYGTAFTMKFGNHTTLVVSDTRIVKECFTTNDTLFANRPSTKAFDLMTYANDSVAFTPYSPYWRELRKISTLKLLSNHRLQSIKDVRVAEVNVCFRGLHVLCKSKIYGAPVLVDMKKWFEEVSNNIVMRVIVGKQNFGSRIVQGQEEAVYYKSVMDELLRLASVSVLSDFAPLFGWLDFFQGNISAMKRNGKKLDVILERWMEEHRQKKISSSSSIAASGAGEDDEQDFMDVMLSIIEETKLSGRDADTVIKATCLAMIMGGTDTTAVSLTWIVSLLMNNRHVLKKAREELDSLVGKDRQVEDSDLKNFVYMNAIVKETMRLYPFGALLERDTKEDCEVGGFHVEAGTRLLVNVWKLQRDPNVWKDPLEFRPERFLVENVDIDVGGQHFELLPFGAGRRVCPGVSFALQFMHLVLARLIHGYELETLNGEDVDLTESTEGHVNHKASPLDLLITPRLDSKVYNY

SEQ ID NO: 1045 - protein, 532 aa, Glaucium flavum
MDSTLVLQCFVGSMAAVSALVFLYNLIFSSSKTTKGKVLRKAPMAAGAWPILGHLHLFGSGELPHKMLSKMAEKYGPAFTLKFGKHTTLVVSDTRVVKECFTTNDTLFANRPSTTAFDLMTYANDSVAFTPYSPYWRELRKISTLKLLSNHRLQSIKEIRVSEVNVCFRELFEMSKSKTDGAAPALVDMKKWFEEVSNNIVMRVIVGRQNFGSKIVQGDAEAVNYKNVMDELLRLASLSMLSDFAPLLGWVDMFQGNKNAMKRNAKKVDTILEGWLEEHRKKNKKMSSSENDEQDFMDVMLSIIEETKLSGRDADTVIKATVLAMIMGGTDTTAVSLTWIVSLLMNNRHVLKKAREEIDAIVGKDRQVEDSDLKNFVYMNAIVKETMRLYPLGAMLERDTKEDCEVGGFQVQAGTRLLVNVWKLQRDPNVWSDPSEFRPERFLSENADIDVGGQHFELLPFGAGRRVCPRVSFALQFMHLVLARLIHGYELGTQNDELVDLTESTEGHVNHMASPLDLILTPRLSNPKLYDY

SEQ ID NO: 1046 - protein, 518 aa, Glaucium flavum
MFFTSSSKTTNKNTSKKPPMAPGAWPILGHLHLFKEGELPHHMLKSMADKYGPAFLMKFGQHRSLVVSDYRIVKECFTTNDTLFSNRPSTTAFAVMTYATDSVAFTEYSPYWRELRKISTLKLLSNNRLQAIKKLRESEVNVCFRGLYDSWRKNKSEQNGAGNSIDGGNERARPVLVDMKKWFEEVSNNLVMRVIVGKRNFGTKIVEGEKEAVEYKTIMDELLRLASLSLLSDFAPILRLFDHFQGHIRTMKRNGKKLDVLLQRWLEEHRRKMSTPEEEQDFMDVMLSIVDESKLSGHDADTVIKATCLAMIMGGTDTSAVSLTWIVSLLMNNRHALAKAREELDKHVGKDRQVEESDLKNLVYLHAIVKETMRLYPLGPLLERETKQDCEVGGFDIAGGTRILVNIWMVQRDPAVWNDATEFIPERFLTEKSDVDVWGGSFELIPFGAGRRVCPGVSFALQFLHLVLARLIHGYELKTPNDMPVDLTESTEGHVNHKASPLDLLLVPRLSDLKLYDY

SEQ ID NO: 1047 - protein, 537 aa, Glaucium flavum
MDSILTTVVLLSILLYFLFSWQLNKYSATKKNTKSSKQLPPEPAGSWPVIGHLHLLAKGSNLPHINLGAMADKYGPIFMIRIGLNPTLVVSSWEVAREIFTTNDQVFSSRPIQVSTKHLGFDTAMYGFAPYGPYWREISKLVKREVLSNTRLEFLKPVWGSEINTSIKELYDVCVMKNKEEGGTGPIIVEMKQWFSDLALNMSVKLVAGKRYFGASQLGNEEAARWQKALRNCFRLVGLFVVSDAIPFLRWLDVGGHEKEMKNTAKELDDLLEGWLEEHKMKKKLSLSEVEAEKKERDRVDFMDVMLSTLEHEKASDYFPADTINKATCLALILGGTDTTTVVWVWALALLVNNPNVLKKAQDELDVHVGKKRQVDESDIKNLTYLQAIIKESMRLYPAATLGIRESTEDCTVAGYHIPAGTSLIVNSWKIQHDPQVWTDPFEFQPERFLTGHMDVDIRGQSCKFLPFGSGRRSCPGTSLALQMVTLTLARLIHGFEFRTPSEAPTDMTESAGLTNVKATPLEVLVSPRLPSELYVC

SEQ ID NO: 1048 - protein, 537 aa, Glaucium flavum
MELINSLEIQPITISILALLTVSILLYKIIWNHGSRKNNKSNKNNRKTSSSAGVVEIPGAWPIIGHLHLFNGSEQMFHKLGSLADQYGPAPFFIRFGSRKYVVVSNWELVKTCFTAQSQIFVSRPPMLAMNILFFPKDSLSYIQHGDHWRELRKISSTKLLSSHRVETQKHLIASEVDYCFKQLYKLSNNGEFTLVRLNTWCEDMALNVHVRMIAGMKNYVAAPGSGEYGGQARRYRKALEEALDLLNQFTITDVVPWLGWLDHFRDVVGRMKRCGAELDSIFATWVEEHRVKRASGKGGDVEPDFIDLCWESMEQLPGNDPATVIKLMCKEHIFNGSGTSSLTLAWILSLIMNNPYVIKKAREELEKHVGNHRQVEESDLPNLLYIQAIIKEGMRLYTPGPFIDRNTTEDYEINGVHIPAGTCLYVNLWKIHRDPNVYEDPLEFKPERFLKNNSDLDLKGQNYQLLPFGAGRRICPGVSLALPLMYLTVSRLIHGFDMKLPKGVEKADMTAHGGVINQRAYPLEVLLKPRLTFQQA

SEQ ID NO: 1049 - protein, 571 aa, Glaucium flavum
MDLQIFFHFQGIVGSLALLSFFYYLWRLLTTTKTSICNGTTAAPPEVSGGWPILGHLLQLVGSKQPLFKVLGDMADKYGPIFVVRFGMYPTLVVSSWEMAKECFSTNDRVLATRPTSAASKYLTYNYAMFAFTFYGPYWREIRKISTIELLSHRRVEMFKHVPFMEIDTCIEQLYLLWMQNQNQNQNQPNGDPVQVNMSKVFEELTMNAVLKLVVGKRLTDDKEGEKLHKTIQEFFKLLEVSVASDVFPFLGWLDVDGQKRKMKRVAKEMDIIAEKWLEEHRQKRSSKLEEEEEEEEDDGGGKGDAAAADKDFMDVLLSLLEGDEGDSDQPFMNYSRDTVIKATSLNILVAATDTTSPTLTWAISLLLNNPHVLREAQNELDMKVGRDRQVEEQDIENLIYLQAIVKETLRLYPAGPLSIPHEAIQDCKLGGYHVRAGTRLLLNIWKLHRDPRVWSNPLEFKPERFLILSEEVCGCSRGTQNFDFKGQCFEYIPFGSGRRMCPGYNFGIQIIHMTLARLLQSFEMQPAKAKSLNDQDGPVDMREGSGLTLPKITPLKVLLTPRLYGQLYNH

SEQ ID NO: 1050 - protein, 534 aa, Hydrastis canadensis
MDFSMLFQWLLVTMATLLFLNSVYNVWYKSSKNTSITTTTSKGKKAPVAAGARPFMGHLHMLVGGKQLPHQALGKLADIYGPAFIIHIGPNPELVVSSWELAKECFTTNDKYFANRPTNKAMKYLTYDEASVGFGPYGPLWVEMRKIAKSNLLSQQRLQMHKRVRVLEIDAFFKELHELWSMKKEDGPVSVDMKQWFEELTLNVITRMVSGKHKYATKARRGDSEAKQFKRVIGEAAHFTGNLLLSDIFPSLGFLDNMQGRVNSMKRTGKELDSILSSWVEEHRQKKLSGEQSEDEEKDFIDLTLSMMDEIQLHSTDSETFIKAICVGVILGGSDTTSVGITWILSLLMNHRDVLKKAQEELDQQVGMDRKVEDSDLNNLVYLRAIVKESMRLYQVGPLIERKASQDCTIGGFHVKAGTRLLVNLSKVHKDPTVWSDPLEFQPERFLTTHSNMDLKGQHFELLPFGSGRRMCPGYLFALNEMYLVLARLIQGFELGTPMDAKVDMTETSSVTNYRATPLQVLLTPRLSPKLYDY

SEQ ID NO: 1051 - protein, 528 aa, Hydrastis canadensis
MAFVALIVVYNIWFKSAASRNKTSYNNKTMSKTPVVDGAKPIIGHLHLLMGGDLPHHALGRLADKYGPIFLMHIGAFPELVVSSSELAKECFTTNDKYIINRPTNKAMTYLSYEQASVGFAPYGPLWIEMRKISKSNLLSNQRIHMQKQVRVAELDAFFKELYQLCRSNDENNNNSTSHGKVLVEMNKWFEELTLNVVTRMICGKQKMGTKARLGDSDAKHYKKTIDEAAHFMGNLVISDVVPCLGMLDNLLGHVSAMKRTGKELDTIFGSWVEEHQQKIRLSGYKDDAEEEEHDFIDLTLSMMKGSTDLHGLDPATFIKSICVGMILGGTDTTSVALTWILSLLLNNRHILKKAQEELDHQVGKERKVEDSDLNNLVFIGAIVKESMRLYPVGPLIEREAIEDCQIGGVHVKAGTRLLINIWKVQQDPKIWPNPSEFRPERFLDSNMDVKGQHFELIPFGSGRRMCPGMSFAINELNLVLARLLQGFELETPMNAKVDMTETSSVTNYKGTPLQVLLTPRLSSKLYM

SEQ ID NO: 1052 - protein, 531 aa, Hydrastis canadensis
MEYSHLLPWLATSIAAIFAFIFLFYVRRRKNNKAFIHNHAKKAPVVPGALPFLGHLRLFTGPILPHKALGALADKYGPAFTIYLGSHQTLVVSGRELVKECFTTNDRLFSNRPRSKAVKYLTYDEASVGFAPYGPLWVEMRKVSKLNFLSNQRIQMQKQALASELNFCFKDVYQLWLKNKELPVMVDMTKWFEEMTLNVITRLICGKQNYGSKANSGESEAKRYKQVVEKAAHLTSTVVMSDVFPFLEWFDKFQGQEKVMKKVANEFDSILGSWVDEHRRKRLLRGNNEEEEEEQDFIDLSLAMMEETQLHGVDPDTFIKSMCLGMILGGGDTTPVALTWALSLLLNNPDIMKKAQEEIDQVIGKERKLDGSDISNLVYLQAVVKESMRLYQVGPLIERETTEDCKIGDFHVEAGTRLLVNIWKVQQDPCVWSNPTEFQPERFLSSKSDMDLKGQHFELIPFGSGRRMCPAVASALQMMHLVLAKLIHGFELGTPMNAKIDMTETSSITNNMATHLQVLLNPRLNANLYDF

SEQ ID NO: 1053 - protein, 543 aa, Hydrastis canadensis
MADFTMLLQWLLLTMATLLFLNAVYKSIKSSKNTINDTSFKKGKKAPVAAGARPFIGHLHMLVGGKQLPHQALGKLADKYGPAFIINIGPNPELVVSSWELAKECFTINDRCFTDRPSNKAMKYLTYDEASVGFAPYGPLWVEMRKIAKSNCAFQQRLQVQKRVRVLEIDLFFKELHELWSHAGAGATGTSVIPLSIDMKKWFEELTLNVITRMVSGKHNYATKARKGDTEAKRFKRVISEAAHFTGRLLLSDIFPSLGFLDNMQGRVNSMKRTGKELDSVLSSWVEEHRQKRVSGNKEQSPEDDDVEQDFIDLTLSMMEEIQLHWTDADTFIKAICVGVILGGSDTTSVGITWILSLLMNHPDVLKKAREELDQQVGLERKVDDSDLNNLAYLRAIVKESMRLYQVGPLIERKAKQDCNIGGFHLKAGTRLLVNLSKVHKDPTVWSDPNEFRPERFFTTHTNIDIKGQNFELIPFGSGRRMCPGYLFALSEIYLVLARLIHGFELRTPNDAKLDMTETSSVTNYRATPLQVLLTPRLSSKLY

SEQ ID NO: 1054 - protein, 532 aa, Hydrastis canadensis
MDYFSMPYQWLLTSLATLIVFVFIWSITAGKTSTTSNKAKKAPPIAAGAWPIIGHLHLIMGGELPHRLLSNLADKYGPIFMLNYGSQPGLVVSSLKLAKECFVHNDRAVFKRPNSKAMKYFTYDQASFGFAPYGPLWVEMRKVSKSNLLSNQRLQLQRNQRASEVDAFIKELYQLCKKSNNGTLMVEMNKWFEELTLNVVTRMVCGKKNIGAKARHGGDNEAKYYKKVIDEATIFTAKLVASDFFPSLGWVDYLHGDESAIKQTAKELDSIIGSWVEEHRQKRLLSLNKDDYAEQDFIDITLSMIDQTQHQGIDADTFVKSMCVGMIFGGSDSTSVALNWALSILMNNRHVLKRAREEIDTLVGKDRKVNDVDVTKLVYLKAIVKESMRLCLVGPLLERVTVEDCEIGGFYVKAGSRIVVNIWKLQHDPDLWSDDVMEFRPERFLTTNSNVELRGQHFELIPFGSGSRMCPGVTFALELMHLTLARLIHGFELGTPMDAKVDMTETSSVTNYKATPLEILLTPRLHPKLYDF

SEQ ID NO: 1055 - protein, 534 aa, Hydrastis canadensis
MFISITQQSMDSFHQYLATIIFGVFSFVLFLIYYLPLKRSRSDKKRAAPKPVGAWPIIGHLPMLSRHQPPHITLGNIADKYGPAFTLQLGVHRALVVSSSEVAKECFTTNDKALASRPSSVALKLMGYNNAMFGFGPYGSYWRQMRKIVVLELLSNHRLQLLKHVRISEVSTSLKELYQVWASCTNKNDKGQVLVDMQQWFGDLTLNVSVRMIAGKRYFGASAACDEDEARRFQKAIKDFLHLVGLFVVSDALPFLEWLDIQGHQKAMKRTFKELDRILGKWVEEHRRNKLDGGTNVGRDFMDVMSSILDDANISDYDADTINKATCLSLILGGTDTTMVTLTWALSLLMNNQHILKKAQDEIDIYVGKDKNVDESDIEKLVYLQAIVKETLRLYPAGPLSGPHEAIEDCTVAGYHVPRGTRLITNLWKIQRDPRIWSSPCEFQPERFLTTQANVDVRGQHFEFLPFGSGRRSCPATSFALQVVHLALARVLQGFEFETQSNAPVDMTESAGLTNVKATPLEVLITPRLPLNLY

SEQ ID NO: 1056 - protein, 529 aa, Hydrastis canadensis
MESLHQYLAAVMSCIFALLLFLYYFPWKIRRSSSDNNMRSAPEAAGAWPIIGHLPMLGGHQLPHITLGNLADRYGPAFTIRLGVCRALVVSSSEVAKECFTTNDKAFATRPSSVAVKLMGYNYALFGLAPYTSYWREVRKIVILELLSNRRLELLKHVRISEVNTSIKELFQVWASSNNKNEKGQVLVEMQRWFGDLTINVAVRMVAGKRYFGASVNTCDDEEEARRFQKAIKNFFHLVGLYVLSDSLPFLEWLDFEGHQKAMKRTFKDVDCILQRWLEEHRRDKENGAMKEERDFMDVMLSILKDANLFGYEADTVNKATSLNIILGATDTTMVTLTWALSLLLNNRHILKKAEDEIDIHVGKDKAVDESDIEKLVYLQAIVKETLRLYPVAPLLAAHEAIEDCIVAGYHVPRGTRLIPNIWKIQRDPRIWSSPCDFQPERFLTTQANVDVRGQHFELFPFGSGRRMCPGISFGLQVVHLALARVLQGFEFDTPSNKAIDMTESAGLTNLKATPLQVLITPCLPLNLY

SEQ ID NO: 1057 - protein, 530 aa, Hydrastis canadensis
MDSILLPTPLMVSLFALLLCLYYLIISRPRSSHNTSTKEAPEAAGALPIIGHLHLLGGRILPHITLGAMADKHGPAFMIRIGVHRALVVSSSEVAKECFTTNDKAFASRPKHTAAELMGYNYAMFGFAPYGPFWSEMRKIIMAELLSNRRLELLKYIRDFELKASIKELYMTWENHSVTNKGQVVVEMKKWFGDLTLNVILRMIAGKRYFGSNSTCDESEAKICQKGMRDFFRLLGEFLVEDAIPYLGWLDLQGFKKEMKNTAKELDILLQGWLEEHKKKREFSKDVKEEQDFMDVMMTILEDANFSDFDADTINKATCLTIISGGSDTTMLTLTWALSLLLNNQHVLKKAQDELDTHVGRDRRVDESDIKNLVYLNAIVKETLRLYPASPLLGIRVSTEDCTVAGYHVPSGTRLMVNAWKIQRDPLVWSDPFEFRPERFLTTHVNVDVKGQNFNLIPFASGRRVCPGVAFALQMLPLVLAHLLHGFKLMTQLGGPVDMTESTGLTNIKATPLEVVISPRLRPELYEMYT

SEQ ID NO: 1058 - protein, 525 aa, Hydrastis canadensis
MESLHQYLATILSCIFAFLLFLYYFPWKGRRSFDNNLRTAPEAAGAWPIIGHLPMLNQRDLPHVTLGNLADRYGPAFTIRLGVRRALVVSSSEVAKECFTTNDKAFATRPSSVAVKLMAYNYAVFGFGPYGSYWREMRKIVILELLSNRRLELLKHVRISEVNTSIKELYQVWASNNKNEKGQVLVEMQRWFGDLTMNVVVRMVAGKRYFGASVTCDEEEARRFQKAIRDFSHLAGLYVLSDALPNIEWLDFEGHHKAMKKTFKDLDCILQRWLEEHRRDRENGATKGERDFMDVMLSILKDANPFDFEADTVNKATSLNMVLGGTETTTVTLTWALSLLLNNQHILKKAQDEINIRVGKDKPVDESDIEKLVYLQAIVKETLRLYPVLPLSVPHEAIEDCTIAGYHVPRGTRLITNLWKIQRDPHIWSSPCEFQPERFLTTQANVDVRGQHFELFPFGSGRRMCPGISFGLQVVHLALARVLQGFEFETPSNVPMDMTESAGLTNFKTTPLEVLITPCLPLDQY

SEQ ID NO: 1059 - protein, 525 aa, Hydrastis canadensis
MDSLLQLQIIGALAALIFTYKLLKVICRSPMTDGMEAPEPPGAWPIIGHLHLLGGQDPIARTLGVMTDKYGPILKLRLGVHTGLVVSNWELAKECFTTNDRVLASRPMGAAGKYLGYNYAIFGLAPHGPYWSEVRKIVLRELLSNQSLEKLKHVRISEINTCLKNLFSLNNGNTPIKVDMKQWFERPMFNVVTMMIAGKRYFSMENDNEAMNFRKVATEFMYLTGVFVVSDALPYLEWLDLQGHVSAMKRTAKELDIHVGKWLEEHRRAKLLGETKNEDDFVDVLLTILPEDLKDNQTYIHDRDTIIKATALALFLAASDTTAITLTWALSLILNNPDVLKRAQDELDKHVGKEKLVKESDIINLVYLQAIIKETLRLYPAAPLLLPHEAMEDCTVGGYHVPKGTRIFVNIWKLQRDPRVWFDPNEFRPERFLTTHANVDFKGQHFEYIPFSSGRRVCPGITFSTQIMHLTLAHLLHEFNIVTPTKSNAGVDMTESLGITMPKATPLEVLLTPRLPSNLYNQYRD

SEQ ID NO: 1060 - protein, 521 aa, Jeffersonia diphylla
MDSLQLIASVVCGLFAFLRIYYLLKKLSSNKEAPQLGGAWPIIGHLHLLGRVELPHIFFSAMADKYGPAFMIQLGMRRALVVSSAEIAKECLTTNDKALATRPSSIAAEIMGYDYAMFGLGPYGDYWREVRKIVVLEFLSNRRLELLKHVRVSEISLSLKELYQSWEKQNKADEPVLVHLDQWFGDMTLNLSVRMVAGKRYFGATAACGEDESRKVQKATREFDRLLGLFVVSDYLPFLRWLDLEGHQKLMKSIGRELDSILQGWLDEHKTRRNSGGGAKGDQDFIDVMLSVLEDGNLSNYDADKLNKATSLTMIVAGSETTMVTLTWAVCLLLNNPEVLNKAQDELDMHIGKDRQVEESDIKNLAYLQAVIKETMRLYPVAPLLIPHEAMEDCTIAGYHVRAGTRVILNGWKLQRDPFIWSDPCEFQPERFLNNDVDVRGRHFELLPFGSGRRACPGISLALNVVSLTLARLLHEFKFSNPSEGKVDMSESAGVVVAKATPLEVLIIPRLPSKFYEYYKL

SEQ ID NO: 1061 - protein, 518 aa, Jeffersonia diphylla
MFSLQLLSTPLFGFFTLLAIYYLLWTKSNKTKEAPQPAGAWPIIGHLHLLARSELPHITLGAMADKYGPAFMIRLGTRQAIVVSNSEIAKECLTIKDRIFATRPSLVAFKLMGYNSAMVGLSPYGPYWRELRKIIALKVLSQRRLESLKDVWDSEISSSLNHLHQIWSHQTEPNGKILVEMDQWFGDLTLNVAVKMVAGKRFFSADAACDENESRRCQKAIREFFRLLGQFVVSDSLPFLGWLDLEGYQKEMKSTAKEVDSILQKWLDEHKQKRQSAGADRDQDFMDVMLSLLEDASLSQYDTDTINKATCFSMIVGGSDTTKITLTWALTLLLNNPDVMKKSQDELDIQVGKDRHVEESDIKNLVYLEAIVKETLRLYPAAPLLAPHEATEDCIVAGYNVRAGTRLIVNAWKIQRDPLIWPNPSEFLPERYLNKDVDVKGQHFELIPFGSGRRACPGITFGLQVVSLTLARLLHEFEISIASGIKVDMTESGGLVTAKATPLKALIAPRFLYSHHHI

SEQ ID NO: 1062 - protein, 525 aa, Mahonia aquifolium
MNSLQFLATPLLTLIALLCVYCIVWRKSFSRNGSKIKQAPWAGGAWPIMGHLHLLAWGDLPHITLGALADKYGPVFMMQLGMRQAIVVSSAEIARECFTTNDRILATRPSSIAVKLMAYNYAMFAFAPYGPNWREIRKTVMLELLSTPRLESLKHVWEDEISTSVKELYELCASKTKTHGHVSVDMKQRFGDLTLNVLVKLVNGKRYFGANTDYTEHESRRCQKAVRDFFSLMGLFVVSDFLPFLERLDLQGYEKEMKRVAREVDGIVQGWLDEHKRKRESSETTHDQDFMDVMLSILKDSKFSNSDYDADTINKATCFNMILGGSDTTMSTMTWALSALLNNPHMLKKAQDELEFHVGKGRQVEESDIKKLTYLQAIIKETLRLYPSAPLLAPREATEDCKIAGYHVPAGTRLIVNVWKIHRDPFVWPNPNEFQPERFLNKDVDVKGQHFELIPFGSGRRACPGVSLGLQVVSLGLARLLHGFELSIPSGSKVDMTETASLVTFKATPLEVFITPRLSPHMYVE

SEQ ID NO: 1063 - protein, 502 aa, Mahonia aquifolium
YAWKRKNHTKDSKIKEPPQPAGAWPIIGHLHLISRGGLPHINMGAMADKYGPVFMIRLGVNRAVIVSNSEIVKECFTTNDKFLLNRPVGLALNLMSYNNAMFGFSRYGPYWREIHKIVMLELLSSSRLESLKHVWDSEILTSIEELYQLCQTQNKAHEGPVLVEMKDWFADMALNVSFRMVAGKRYFGASAGGNKDEARRCQKTMRDFFRLVGLFIVSDALPFLRWLDLGGHQKEMKRTFEDLDYVLQGWLDEHKLNRKSGGNGDQDFMDVMLSTLYDSKFTDYDVDTINKATCFQLILGGTDTTTVTLTWALSLMLNHPHVLKKAQDELDIQVGKHRQVEESDIKNLKYLEAVIKETLRMRPVGPLLGPREAIEDCTIGGYRVRAGTRVMVNAWKVQRDPSVWPNPDDFKPERFLKKDIDFRDQNFEFIPFGSGRRACPGISFAVELLPMALARLLHGFELKTQLGCKVDMTEHAGLVHAKATPLEVLVSPRLSRELYVSS

SEQ ID NO: 1064 - protein, 529 aa, Menispermum canadense
MDSTDHHLALVIPTLLATPVLLFSFYCLLLRPRSLKKPRTNKPPEPSGSWPIIGHLHLLSQGLPHITLGAMADKLGPAFSIRLGTRRALVVSSWEVAKECYTTNDRAFASRPSSIAVKLMSYNNSILGFAPYGQYWRELRKIVVLQLLSNRRLESLKNVWESEIDLSIKELYDTWASNRGGEALMVDMKQWFGDLTMNIVVRLVVEKRCFGRSVGDDETEARRGQRALKEFLKLVGLFLVEDAFPFLSWLDVQGHQREMKRIARELDSLFQGWLEEHKRKRSIKGEAKGDQDFMDVMLSVLEDSTISTDIEDDTVIKSTCLTVVLGGSDSTVGTLTWALSLLLNNRHELKKAQDELDAYVGKERQVDESDIKNLVYLQAIVKEVLRLYPAGPLSGPRESVEDTVVAGYHVPKGTQLIVNLWKIQREPSIWADPLEFQPERFLTTHKGMDVWGQHFELIPFGSGRRSCPGTAFALQVIHLTLARLLHGFELTTPCGAPVDMSESAGLINVKTTPVEVHVAPRLPLKLYKS

SEQ ID NO: 1065 - protein, 529 aa, Menispermum canadense
MILIAMGNHIELQDIILYSLGFFAATILWRIFSTYVLRRNSCSRPPEAAGKLPLIGHLHLLGANKILHHTLGDMADRHGPIFSLNLGIKRTLVITSWEVAKECFTTQDRVFATRPKSLVGKVVGYNSTVMIFQQYGPYWREIRKLAMIELLSNRRLEMLKHVRESEVNLFIKELYEQWSSNENGSKVVVEMKERFGDLTTNIVVRTVAGKKYSGTGVHGNEESRRFQKAMTDFMHLAGLFMVSDALPLLGWIDTFKGYRGKMNKTAEEIDHVLGSWLKEHQQKRKNISINHLDEDFIHVMLSAMDGNQFPDIDTETAIKGTCLSLILGGYDTTSATLTWALSLIVNNHHVLKKAQDEMDKYVGRDRQVKESDVKNLTYLQAIVKETLRLYPAAPLSVQHEAMEDCTVAGCNIPAGTRLVVNLWKMHRDPKVWSDPLEFQPDRFLQKHVNVDIWGQNFELLPFGSGRRSCPGITFAIQVLHLTLAQLLHAFQLGTVFASPIDMTESSGVTNPKATPLQVTLTPRLPPEVY

SEQ ID NO: 1066 - protein, 513 aa, Menispermum canadense
MDSTYQLLSALLFILCLYYLVCKPITKTKNDEAPVPAGAWPIMGHLHMLRGPNLPHITLSSMADKHGPAFTIRLGTRRALVVSNSDLAKECFTVNDKAFSTRPSTVATKLMGYNNTMFGFAPYGPYWRELRKIVMTELLSSRRLESLASVWASEIESSVKELFAEWAENRAKGPVVVEMGEWFGNLTLNIALRMVVGKRYLREESRKCLKAMRDYPELFGRFLVEDAVPFLGWLDLIQGYQREMKKTARELDSVLEKWLVEHKDKRGSGEGKGEHQDFMDVMISVLEDSKLSYGEADTVNKSTCLNLILGATDTTMVALTWALSLLLNNKQVLKRAQQELKSQIGNNKQVSQSDIKNLLYLQATVKEALRLYPPEPLSGPREALEDCTVAGYRVRAGTRLIVNLWKIHRDPSIWQVPLEFRPERFLTAHKDVDVWGQHFELMPFGSGRRSCPGISFVLQVVPLILARLLHGFELTTPGEALVDMSESAGLVNAKVTPLEVVISPRLPLELFAG

SEQ ID NO: 1067 - protein, 534 aa, Menispermum canadense
MIMMFIDYYSSWLPQTLLLQSILLAVSLVIFINLFLTRRRSYSSKSHTNIIHPPKAAGALPVIGHLYTLFRGLSAGVPLYRQLDAMADRYGPAFIIHLGVYPTLVVTCRELAKECFTTNDQTFATRPSTCAGKYIGYNYAFFGFAPYGPYWREARKIATVELLSNYRLDSLRHVREAEVGRNVDELYALHASSSTNKQNMMKIDMKQWFDQVTLNVILMMVVGKRCVTTGGNEEEVRVVKVLHEFFKHLGTLSVSDVVPYVEWMDLDGNIGRMKSTAKELDCILGRWLEEHRRERRSDFMDAMLAMVEGIKIPYYDSDTVIKAICLNLLNAGSDTLGITMTWALSLLLNNRHVLKKVKDELDVHVGKNRQVEELDVKNLVYLHAVVKETLRLFPPAPLGVPHEAMEDCVVGGFHVAKGTRLVVNVWKLHRDPSVWSDPLAFKPERFLDNNTVDVRGQHFQLLPFGSGRRGCPGITFALQVAHLTLARLLHGFEWDTPDGAPVDMSEVSVLTTAKKNPVEVLFTPRLPAEVYTQN

SEQ ID NO: 1068 - protein, 523 aa, Menispermum canadense
YQLLFLQTAIAGLLFALALLVRLRFSRRNNGKKKQAPPEPAGARLIMGHIHMLNSGEQPHKTLAALADQYGPVIKLRLGLRDAIVVSNWEMAKECFTTNDKIFLSRPQTVVSKFMSYNLKMLGFAPYGPYWREIRKIVVSELLSNRRLELLKNAWTSEISSWVKELFDEWGAKEARGPVVVDMRHWFGNLAFNIGMNMVAGKRFFGPRVVSDEDGLRRVQQGLTDFFRLIGAFLLEDAVPFLSWWDSQGYQKEMKDTAREMDTLIQGLLDEHKRRRSSSSGEAKGEKDFMDVMLNILEGSKFPSGDADNINKSTCLSLMLGLTDTTTATLTWALSLLLNDPRVLKKAREELDFHVGKNRLVDTSDLMNLPYIHAIVKEVLRLHPPAPLSGHRESLEDSVVGGYHVPKGTRFMVNVWKIHHDPNKWPDPIEFRPERFLTTHKDVEVWGQNFELIPFSSGRRVCPGASLSLQVLPFTLARVLQGFEVATPGGAPVDVTESKGLSTAKETPLDVVITPRLPEKFYH

SEQ ID NO: 1069 - protein, 528 aa, Nandina domestica
MDSLISFQAIVGLFILILVSYQWLGRSRSIKTNKHNEAPEPAGRWPIIGHLHLLGGSDQLLYRTLGSMADKLGPAFNIRLGSRRAFVVNSWEVAKECFTINDKALASRPITVAAKLMGYNYAVFGFAPYSPFWRAMRKIATLELLSNRRLEMLKHVRISEVDMGLKEIYGLWSKNKDSGPLMIELNRWFENLTLNMVVRMVAGKRYFGADASCDENEAQRCQKAISEFFRLIGIFVVSDAIPSLWWLDLQGHEKAMKRTAKDLDSILGGWLEQHRSRRVNGKVPTEGEQDFIDVMLSLQEGDHLSDFEYDADIAIKSTCLALILGGSDTTAGTLTWAISLLLNHPYALKKAQEELDLHVGKDRQVYDQDIKNLVYLQAIIKETLRLYPAGPLLGPREAMEDCTISGFDVRAGTRLVVNVWKIQRDPNVWSNPSEFSPERFLTSHVDVDVRGQNFELMPFGSGRRSCPGASFALQVLHLTLARFLHGFGLANPLGKPVDMNESPGLTIPKATPLNVLLTPRLDSELYGC

SEQ ID NO: 1070 - protein, 520 aa, Nandina domestica
METFQFLGIPLFGFFALLCTYYLVLRKPSSTKIREPPRPAGAWPIIGHLHLLARGDLPHVTLGKMADKYGPVFKLKLGVRQAIVVSDWEVAKECYTTNDRALANRPSGLGAKIMGYNYALIGSAPYGPYWRDLRKIITLEVLSSRRLESLKHVWDSEISTSVKELYQIWADQNKAQGQVSVEMKQWFSDMTLNVAVRLAVGKKYLGATADCEKNKAVQCQKAIRNFFRLAGLFVVADYLPFLGWLDLGGHEKEMKHTAKELDYIAQEWLDDHKKKRTSNRTVDEPQDFMDVMLSILEESTFTGYDVDIINKSTCFALILGGTDTVAVTLTWALCLLLNNPHVLKKAQDELDIHVGKDRHVNESDIKNLVYLQAMIKETLRLYPAGPLLGPRQVIEDCTIAGYHVRAGTRVIVNAWKFQRDPSIWSNPCEFQPERFLDKDIDVKGQHFELIPFGAGRRACPGISFALQVLPLALARLLHGFELKNPSESQVDMTETPGMVHAKTTPLEVLITPRLSPKFYV

SEQ ID NO: 1071 - protein, 495 aa, Nandina domestica
WKRPTSVKYREAPQPAGAWPIIGHLHLLARGDLHHITLGAMADKYGPAFMMRLGVHQAMVVSDSESAKECSTTNDRVLATRPSSVAVKLMGYNYAMFGFGPYGSYWREIRKIVILEVLSNHRLESLKHVWKSEISMSTKELYQLWINQNKDEGPTLVELKQWLCNMTLNIGVRTVAGKRYFGASSCDANESNRIQRAIRDFFRFVGLFVVSDFLPFLGWLDLEGYQKEMKSIARELDSILQGWLDEHTRKRQSGGTNENQDFMDIMLSVLEHSNALTHYDADTINKATCFTMILGGSDTTMVTLTWALSLLLNNPHVLKKAQDEIDIQVGKDRLVDESDIKNLVYLQAIVKETLRLYPAVPIITPHEAIEDCTIAGYHVPAGTRLIVNAWKIQRDPLIWDNPGEFQPERFLYKDVDVKGKHFELIPFGSGRRVCPGISLALQVVSLAMAHLLHEFDLAKPSEGNVDMTESVGLVNAKATPLEVLITPRLSPKFYE

SEQ ID NO: 1072 - protein, 525 aa, Nigella sativa
MGSFNQINPSVVYFAAFTIFFFFFLYKILYKRRTSAKTRVAPEPAGAWPFIGHLPLLSQQNLPHVTLGVLADKYGPAFTVQLGLHKAVVVSSWEVAKECFTVNDKVLATRPSSVAVKIMCYNYAVFGFGPYGSYWREARKIVVRELLSNHRLNLLKHVLVTEISMSMNELYTVWQKNANNVSGKALVEMKQWFGDLSLNMIVKIVAGKRYFQASANSDERDQLKRGVQDLFHLVGLFLVSDALPFLSWLDIGGHEKAMRRTAKELDNILGSWLDEHKQAKLAGATKGEQDFMDVLMSILEDNNNLPEYEPDVVSKAICLGMILGGADTTTITLTWIVSLLLNNQHILKKAQDEIDSKVGKDRQVNESDIEKLVYLQAIVKETLRLYPPAPLSTQHEAMEDCTIAGYHVQAGTRLITNIWKIQRDPGVWPNPCEFQPERFLTTHANVESNGKHFEFIPFGSGRRACPGMSLGLQVVHLTLARLLQGFELETPLSVEVDMTESAGLTNLKVTPLEVLINPRLPSNLY

SEQ ID NO: 1073 - protein, 517 aa, Nigella sativa
MDLTSILICIFLFIISICFLSWKRSRSLSGTRAAPEPVGAWPVIGHLRLLMGSKTPHMTLGNLADNYGPAFTIRLGTKKTLVVSSWEVAKECLTTNDKAFAGRHSTMAVEIMGYNYAFFSLGPSGQYWREIRKITVSELLSNRRLELLKHIWSSEIKTSIKELYEICAAQSQYGKKQSPMVEMQQWFSHLNLNLSARMVVGKRYFADGVEENEGDIRRFQNAIKEFFYWAGAFIIADTIPYLRWMDFLNERSMKRTAKETDHVLEGWLQEHKRNRLNGVTKEQDFMDVLLTELGDKDLCGYTADVVNKATCLNMIFGGTDTTKTGMIWTLSLILNNPQVLKKLQNEIDIQVGKDRQVDDSDIGNLVYLQATVKEAMRLYPPATIFGRESIEDCTVAGYHIQAGTRLIVNAWKIQRDPNVWPNPDEFQPERFLTNQADVDFRGQDFELIPFGAGRRACPGISLTVRVTHLTLACLLQGFNFETPLNEPVDMSEKYGLTNSKATPLNVILTPRLPSNLY

SEQ ID NO: 1074 - protein, 530 aa, Nigella sativa
MDSIFHMYAPINILAATFVFIVISVWFLLWMKRSRKNSKSRRAPEPVGGWPLIGHLRLLVGPELPHVILGSLADKYGPALSIRLGMRQALVVSNCEVVKECLTTNDRCFSTRPSSVAVELMGYNYASFGLGPYGGFWREVRKIAILELLSNHRLKSLKHVWISEISGFVKELYQLCVANGNTGRQSALVEMRQWLNDLTLNVSVRMVVGKRYFGSGSEHGGEDVKRFQKAIKDFFRLAGKFTLADAIPFLRWLDFGHERAMKKTAKELDYVLARWLDQHQKNKLNCETKQVDQDFMDVMLTVLGDKDLYGFKADVVNKATCLNLILGGVDTTSVTLTWALSLLLNNPNILNKAQEEIDVQIGKDRQVDDNDLGKLVYLEAIVKETMRLYPAGPLSGARAAIEDCMVAGYHVPKGTRLIVNTWKIQRDPEKWDNPSEFRPERFLITTTNGHVEVWGQHFEYIPFGSGRRICPAISFSLQLVHLTLARLLQAFSFQTPSNAAVDMTETPGLVNFKATPLQILLTPRLPSSLY

SEQ ID NO: 1075 - protein, 527 aa, Nigella sativa
MLSIHDSTMVFLQLQAICGIFGFIFIITWWTRWKSSNKMKAPEVAGAWPVIGHLHLLGGGRPLYQLLGDMSDKYGPAFTLRMGIQKALVVSSWEVAKECLTTNDRALATRPSSAGGKYMGYNNALIPFSPYGPYWRDMRKIATLELLSNHRLEELKHVREMEINTCISDMYKLCQVEDGVEIKPISVDLSQWFADLTFNVVVMMITGKRYIGSTDAGDMNEIRHFQAALVKFMRLLRISLLVDVFPVLQWINYGGFKGVMKSTARDIDSVLENWLQEHQRKRLSPDFNGNHDFIDVMISTLEGTEFSDYDHNTIIKAISMAMVVGGTDTTTTTLIWAISLLLNNPNAMKKVQEELEIHVGKERNVDGSDIQHLVYLQAVVKETLRLYPPVPLSVMHQAMEDCVIGSYNIQAGTRVLFNLWKLHRDSSVWSDPLEFRPERFLTSHVDVDVRGQHFELIPFGSGRRSCPGISFALQVIHLTIARLFHGFNLTTPGNSSVDMSEISGATLSKVTPLEVLVTPRLSSKLYN

SEQ ID NO: 1076 - protein, 520 aa, Nigella sativa
MDFLIYVAAFAAAFFFLLFYNILSKRITGTKRRIAPEPAGAWPFIGHLPMLFGPNLPHVTLGALADKYGPAFTIQLGLHKALVVSSWEVAKDCFTVNDKALATRPTSAAVKIMAYNCAVFSFSPYGSYWREARKIAILELLSHHRLDLLKHVRKSEVSTSIRELYQFWQKNATEVTKFAQLEMKQWFGDLTMNLIVRMVAGKRYASVQSDDDGEGKRLQKAVNDFFHLVGLFVVSDALPFLGWLDIGGNLKTMKKTARELDSIMECWLKHQARRSNGEQDFLDVMLSILREDNKLQEYDGDVVVKAMCLNMILGGADSTTITLTWTISLLLNNRHILQKAQDEIDSKVGKDRQVNESDIEKLVYLQAIVKETLRLYPPAPLSSQHEAIEDCTIAGYHIPAGTRLITNLWKIQHDPSVWHNPSEFQPERFLTTQANVDFRGQNFEFIPFGFGRRSCPGTSLGLQMVHLPLARLLQGFTFETPSNAAVDMTESAGLTNHKVTPLEVLISPRLRFDLYQESPP

SEQ ID NO: 1077 - protein, 525 aa, Nigella sativa
SFNQTYTGFICLSVFASFFFFFLYSVQQKRRTGRKARYAPEPTGAWPLIGHLPILFEPNLPHIQLGALADKYGPVFSIKLGLRKALVVSSWEVVKECFTVKDKVLASRPSSVAVKIMGYDYAVYAFGPYGSYWREARKLTILELLSDHRLDLLKHVRVSEVSMSMKELLKFCQKNANNVSGKALLVDMKQWFGDLTLNVIVRMVAGKSYLGASAKLEDGEQKRLQNAIHEFFRLAGLFVVSDALPILSWLDIGGHEKAMRRNAREIDKIMSSWLDEHRRNKLAGVTNGEQDFMDVLLSKFENSNLPGYEPDVAIKAICLNMILGAADTTIVTLTWVVSLILNNRQILKKAREEIENKVGKDRQVNESDIEKLVYLQAIVKETLRLYPAAPLSAHHESMEDCTIAGYHVPAGTQLITNLWKIQRDPRVWPNPCEFLPERFLTTHANVNYKGQNFEFIPFGYGRRSCPGMSFGLQMVHLVLASLLQGFELETPLNEAVDMTESAGLTNLKATPLEVLITPRMPLNLY

SEQ ID NO: 1078 - protein, 509 aa, Nigella sativa
VTVIYLFTFAIFFYLYSILWKNPRKSAKTRVAPEPAGAWPFMGHLPMLLEPNLPHIKLGALADKYGPAFTVQLGLHKALVVSSWEVAKECFTVNDKVLADRPSSVAVKIMGYDNAVFAFGPYGSYWREARKISTVELLSNHRLSLLQHFRISEASMSMKELYQLCANNGKALVEMKKWFGDLSLNVIVRMVAGKRYAKASEDDERRQLQKGLKDFFYLVGLFVVSDALPILSWLDIGGHEKAMRRTAKELDTIMERWLDEHRRAKLAGVTKGEQDFMDVLLSILEDGKLPHYESNTVNKAICLTMILGAAHTTTVTLIWTLSLLLNNRHILNKAQDEIDSEVGKDRAVTESDIKNLVYLQAIVKETLRLYPAAPLPAHREVMEDCIIAGYHVPVGTRIITNLWKIQRDPRVWSNPCAFQPERFLTTHSNVDFRGQNFEFIPFGSGRRSCPGISLGLQMVHLALARLLQGFELETPLNLGIDMTESSGLTNLKVTPLEVVITPRLPSNLY

SEQ ID NO: 1079 - protein, 562 aa, Papaver bracteatum
MAYLMIKKSFHLFSDQPTSVSTLIVLAFLLTLSPVIIYYEQKKRGLRRNRTSSSCTAITTTPLPEASGAWPVIGHLLLFMNENDLNHATLGNMADKYGPIFSLRFGSHRTLVVSSWEMVKECFTGANDKFFSNRPSSLAVKLMFYDTESYGFAPYGKYWRELRKISTHKLLSNQQLDKFKHLRISEVDNSFKKLHDLCSNNKLGGETTSVANLVRMDDWFAYLTFNVIGRIVSGFQSNAVSGATSSQEKYKLAIDEVSNLMATFAVSDVVPCLGWIDRLTGLTGKMKKCGKKLDAVVGDAVEVHRQKKLKISRNTAGELTEHEEEDFIDVCLSIMEQSQIPGNNPEISVKSIALDMLSGGSDTTKLIMTWTLSLLLNHPDILDKAKEEVDTYFRKKKISDNTPVVDAADVPNLVYIQAIIKESMRLYPASTLMERMTSDDCEVGGFHVPAGTRLWVNVWKMQRDPRVWNDPLVFRPERFLSNDKGMVDVKGQNYELIPFGTGRRICPGASFALEVLHLVLTRLILEFEMKAPEGEIDMRARPGFFNNKVVPLDVLLTPRTLD

SEQ ID NO: 1080 - protein, 519 aa, Papaver bracteatum
MNNYSSSPASSTETAVLCHQRQQSCALPISGLLHIFMNKNGLIHVTLGNMADKYGPIFSFPTGSHRILVVSSWEMVKECFTGNNDTFFSNRPIPLAFKIIFYAGGVDSYGLALVPYGKYWRELRKICVHNLLSNQQLLKFRHLIISQVDTSFNKLYELCKNSEDNQGMVRMDDWLAQLSFSVIGRIVCGFQSDPKTGAPSRVEQFKEAINEASYFMSTSPVSDNVPMLGWIDQLTGLTRNMTHCGKKLDLVVESIINDHRQKRRFSRTKGGDEKDDEQDDFIDICLSIMEQPQLPGNNNPPKIPIKSIVLDMIGGGTDTTKLTTIWTLSLLLNNPHVLDKAKQEVDAHFLTKRRSTNDAAVVDFDDIRNLVYIQAIIKESMRLYPASPVVERLSGEDCVVGGFHVPAGTRLWVNVWKMQRDPNVWADPMVFRPERFLSDEQKMVDVRGQNYELLPFGAGRRICPGVSFSLDLMQLVLTRLILEFEMKSPGGEVDMTATPGLMSYKVLPLDVLLTHLSAS

SEQ ID NO: 1081 - protein, 540 aa, Papaver bracteatum
MEFLMKLLLLLEPITFSIFLGIGSIVLLYNVFFLVINKKKKKKAPNASGAWPLIGHLNLFMNDKEALYKTLGTMADKYGPAFNVRLGNQEILVVSNWKMVKECFNTQNDKLFSNRRTTLGVKYMLNKKTSVAFSPYGTYWRELRKLTVQQLLSKQRLDSWKHLKIKEIDASFGRLNDLCSNNKGTGAATPIRMDSWFAELTFNVFARIVFGYQSGERLMLSGDTASNGERYKKTLEEAFLLMSSFAVSDVFPCLEWVDRSRGLVRSMKRFGDQLNSIAGCLIEEHRQKRSQSVSASNSTNDKGVGDEQDFIDVLLSVAELSQIPGDDPDLVIKSMILEALAGGSDTTTSTLTWVLSLLLNHPKVLKTAKEEIDMHVGRNRCVEESDIPKLVYVNAIIKESMRLYPNGSLVDRLTLEECEVGGFHVPAEGHLFVNVWKIHRDPSVWENPLEFKPERFLSNDCKVDMDFISQKYEFIPFGIGRRICPGMLSALQVMHFVVARLIHGFDMEAASADGKVDMAEKPGMTCYKMTPLEVMLTARQ

SEQ ID NO: 1082 - protein, 548 aa, Papaver bracteatum
MYPVNQLQSQAIAVLCAVIVFIFYLGRKLFNSTHIHKPGKTAPEPAGAWPIIGHLHLLGGAKLMYRTLGSLADEYGPVFMVRLGMRRVLVISNTASARECFTTNDKVFATRPTTVAIKLLTYNHTMFGFAPYGPYWREIRKIATTELLSDRRLAMLKNVWISEINLCINELHQLLMDKNSRKVDHHQHVYNQNMDPISVEMNGWFADLSFNVVARMIAGKRYFGKNTDGGEEETRRYREAMNDFMHLVVILLVSDAVPFLGGLDFQGYKKRMKKTAKEIDYFLGKWVDEHRQRLKYKNISKVDQQDDFIDVLLLNLNDQPIYGRDTDTIIKSTCLSLIAGGSDTTAVTLTWALSLLLNNQHVLRKAQDELDIHVGRERQLEESDIKNLVYLQAIVKETLRLYPAAPLSAPRMAMEDCTVAGFQVSKGTQLMLNVWKLHRDPHFWGPDPLEFRPERFLTADGSSTGSGHCIDIDVKGRHYELLPFGSGRRMCPGVSFAMQVVHLTLATLLHGFHLSTPTDGPVDMTETSGLSCPKATPLEVLLTPRLPC

SEQ ID NO: 1083 - protein, 567 aa, Papaver bracteatum
MDVAIIVDHHYLQPFVSIAGLLALLSFFYCIWVFIIRPRIIKSNLDERKLSPSSPPEVAGAWPIVGHLPQLIGSTPLFKILADMSNKYGPIFMVRFGMYPTLVVSSWEMSKECFTTNDRLFATRPPSAAGKYLTKALFAFSVYGPYWREIRKISTIHLLSLRRLELLKHGRYLEIDKCMKRLFEYWMEHHKNIISTTSSVKVNMSQVFAELSLNVVLKIIVGKTLFIKNGNEDYTKEEEEGQKLHKTILKFMELAGVSVASDVLPFLGWLDVDGQKKQMKRVYKEMNLIASKWLGEHRERKRLQIIQKRGAARGSNYDDGNDFMDVLMSILDEENDDLFFGYSRDTVIKSTCLQLIVAASDTTSLAMTWALSLLLTNPNVLQKAQDELDTKVGRDRIIEEHDIECLVYLQAIVKETLRLYPPAPLSLPHEAMEDCTVGGYQVKAGTRLVVNLWKLQRDPRVWSNPLEFKPERFLPQSDGGFGGEEARMDFRGQHFEYTPFGSGRRICPGIDFFLQTVHMALARLLQAFDFNTAGGLVIDMVEGPGLTMPKVTPLEVHLNPRLPVTLY

SEQ ID NO: 1084 - protein, 558 aa, Papaver bracteatum
MQVDWPNILQKYYPIITCSLLTLLSFYYIWVSITKPSRNSKTKLPPPEVAGSWPIVGHLPQLVGSTPLFKILANMSDKYGPIFMVRFGMHPTLVVSSWEMSKECFTTNDKFLASRPPSASAKYLGYDNAMFVFSDYGPYWREIRKISTLQLLTHKRLDSLKNIPYLEINSCVKTLYTRWAKTQSQIKQNVGGAADDFVKVDMTEMFGHLNLNVVLRLVVGKPIFIQKDNADEDYTKDGHNKEELGQKLHKTIIEFFELAGASVASDVLPYLGWLDVDGQKKRMKKIAMEMDLFAQKWLEEHRQKGINHDNENDFMAVLISVLGEGKDDHIFGYSRDTVIKATCLTLIVAATDTTLVSLTWALSLLLTNPRVLSKAQDELDTVVGKERNVEDRDVNHLVYLQAVIKETLRLYPPSPLAVPHEAIENCNVGGYEVKARTRLLVNLWKIHRDPRVWSNPLEFKPERFLPKLDGGTGEASKLDFKGQDFVYTPFGSGRRMCPGINFASQTLHMTLARLLHAFDFDIESNGLVIDMTEGSGLTMPKVTPLQVHLRPRLPATLY

SEQ ID NO: 1085 - protein, 571 aa, Papaver bracteatum
MMDLAMFIDQYFSLAKIAGLLALLSFFYYLWISTLWSPRNPKLSSVSPPEVAGAWPILGHLPQLLGSRPLFKILADMSDNYGPIFMVRFGMHPTLVVSSWEMAKECFTTNDRFLAGRPSGAANKYLTFALFGFSTYGPYWREIRKIATLHLLSHRRLELLKHVPDLEVTNCMKHLHRRWIDSQNQIKQNDAAAGSVKVDMGRVFGELTLNVVLKLVAGKSIFFKNDNTRQYDSKDGHNKEEEEGKKLHKTIIDFYSLAGASVASDVLPFLGWLDVDGQKKRMKRVAKDMDFIAAKWLEEHRHQKRQTVLSSSATLGSSNHDDAKDFMDVLMSILDGENDDLFFGYSRDTVIKTTCLQLIAAAADTTSVTMTWALALLITNPTILRKAQDELDTKVGKDRNIEERDINDLVYLQAIVKETLRMYPAGPLNVPHEAIADCNIGGYEVRAGTRLLVNLWKMHRDPRVWSNPSEFKPERFLPQLDGGSGGEAANLDFRGQDFEYLPFSAGRRMCPGIDFSLQTLHMTLARLLHGFDFNNDSAGIIIDMEEGSGLTMPKLTPLEIYLCPRLPAKLY

SEQ ID NO: 1086 - protein, 543 aa, Sanguinaria canadensis
MEFLSLQFQPITIFALLLATPIFLYNLWNYGRKLNNKNKKSRKPPAPEASGGWPIMGHFHLFNGTEVTHRALGSMADKYGPAFNIRIGSHPTLVVSSWEIAKECFTTNDRLFSNRPGSLAIKLMFYDADSVGYAPYGTYWRELRKISTLKLLSNHRLETLKHLRTSEVESCFKQLHDLWRMNNKKGGSDDGSDFALVRIDNWFGDLTFNVVARIVAGKKNFAGGAASGDAGAQRYKEAMDEAFRLMTRFAFSDVVPSLGWLDKLTGLVGGMKRCGSEIDSIVASWVDEHRLKRISGKEGDDLEQDFIDVCLEILEHSTLPGDDPEVVIKSTCLDMILGGSDTTTVTLTWALSLLLDHPHVWKRAKEEVDAHVGKERQVEDSDIPNLVFIQAIVKETMRLYPAGPLIERRTMDDCEVGGFHIPGGTRLIVNLWKIQRDGSVYKEDPLEFRPERFLTSNAEVDLKGQNYELIPFGAGRRICPGVSFAVQLMHLVLARLIHDFEITMPMGAKVDMTESGGLISHKVTPLEVLLKPRLPSLQQAALY

SEQ ID NO: 1087 - protein, 525 aa, Sanguinaria canadensis
MEYSSVLLHWFPASMAALLALVFLYNLIFNSPKTGNKKIIRRAPKAAGAWPVLGHLHLFGSGELPHKMLAAMAEKYGPAFTMKFGKHTTLVVSDTRVVKECFTTNDTLFANRPSTKAFDLMTYANDSVAFTPYSPYWRELRKISTLKLLSNHRLQSIKEVRVSEVSVCFRELYDICKNDGGGAPPVLVDMKKWFEEVSNNIVMRVIVGKQNFGSKIVCGEEEAVNYKNVMDELLRLASVSMLSDVAPLLGWLDMFQGHMSAMRRNGKKLDTILERWLEEHRKKKSEDEQDFMDVMLSIVEETKLSGRDADTVIKATCLAMIMGGTDTTAVSLTWIVSLLMNNRYALKKAREELDALVGKDRQVEDSDLKNLVYLNAVVKETMRLYPLGTLLERDTKEDCEVGGFHVEGGTRLLVNVWKLQRDPNVWNDPLEFRPERFLTENADIDVGGQHFELLPFGAGRRVCPGVSFALQFMHLVLARLIHGYELGTQNDEDVDLTESTEGHVNHKASPLDLLITPRLHPKLYE

SEQ ID NO: 1088 - protein, 527 aa, Sanguinaria canadensis
MDYSSHLNQFYGVAPYMAALLIALVFLYNILWASPKTTNKKPIMAAGAWPILGHLHLFKDGELPHHMLKSMSDKYGPAFLMKFGQHRTLVVSNYRMVKECFTTNDTHFCNRPSTTAFDVMTYANDSVAFTAYSPYWRELRKISTLKLLSNNRLQAIKNLREAEVNVSFRGLYDLWKNNSDRAASVLVDMKKWFEEVSNNVVIRVIVGKHNFGTKIVKGEKEAVEYKTIMDELLRLASLSLLSDFAPILGWVDFFQGNVRKMKRNGKKLDVVLQRWLETHRRKKNSPEDEQDFMDVMLSIVEEGDKLSGHHADTVIKATCLAMIMGGTDTSAVSLTWIVSLLMNNRHALKKAREELDMYVGKDRQVEDSDLKDLVYLHAIVKETMRLYPLGTLLERETKEDCKVGGFHVEAGTRLLVNIWMVQRDPTVWSDPTKFIPERFLTEKADIDVGGQHFELIPFGAGRRVCPAVSFALQFLHLILARLIHGYELGTPNDADVDLTESPEGHVNHKASPLELLLTPRLDPKLYI

SEQ ID NO: 1089 - protein, 535 aa, Sanguinaria canadensis
MNSIAVVGVLLFFLYYLWRTLFTTHKAAPPPQPAGARPIIGHLHLLGGANQLVHQTLGSMADKYGSIFMIRLGMRRVLVVSSSELAKECFTTNDKVFLNRPSSLALKLMAYNNAIFGFAPFGPYWRKMRKIAVTELLSNRRLEILKNIRISEINMSIKELHQLWVDMNSGDDQVGGPPIVVEMRKWFGDLSFNVVGRMIAGKRYFGRNCDCDEEETRRYQKAMGDFMHLVGVFVVSDAIPLLGFLDLQGYEKKMKRTAMDIDCVLGRWVDEHRRRRQDHDEKRIMVSDDDHQGQDFIDVMLSILNDDDQFYGYDADTVIKSTCLSLIAGGHETTAVTLTWALSLLLNNRHVLQNAQDELDIHISKERQVDESDIKNLKYLQAIVKEALRLYPALPLSALRLAMEDCTIAGFHVPKGTELMLNLWKLHRDPHVWSDPLEFKPERFLTNSTHEEVDVGGQHYELLPFGSGRRMCPGVSFALQVLHLTLARLLHGFHLSTPSGVPVDMTQSFGLSCPKATPLDVLLTPRLPSKLYYVA

SEQ ID NO: 1090 - protein, 601 aa, Sanguinaria canadensis
MISTTPDVLATSSYSSSNKHMDSDHLYRFSTSTSIVIGLFILLFFLVLLWKPKKQSATSKTNKPTREQRAPEPSSSWPIIGHLRLFGGPNSLPHITLGAMADKYGPVFTIRMGSRPVLVVSSWETAKECFTTNDRVFASRPRTIAIKHMCYEHVMLGFAPYGSYWRELRKIVNRELLSNNRLELLKHVWGSEINTSIKELYELWLVNKNNIEAEGENEGTSDRVLVEMERWFADLTLNMSIKIVVGKRYPSGVTAGGSSGCDDDEAQRCRKALRDFFKLVGLFLVSDAIPFLRWLDLGGYEREMKTTARELDCLMEEWLEEHKMKRRLLISPSAGDHHEAAEIMINKQKEAELQEYDFMDVMLSILDDDIEGKNLSDYDVNADTINKSTCLNLILGGSDTTMVTLTWALALLLNNPHVLQKAQDELDIHVGSKRQVDDSDMKNLIYLQAIVKETMRLYPAGPLSVPHESTEDCTVAGYHVPAGTRLIVNTWKIQRDPRVWSNPSEFKPERFLTDSHVDIDVRGRNFELIPFGSGRRSCPGTSFALQVVHLVLARLIHGFEFKTPSEAPIDMTESVGLSNFKATPLDVLLTPRLPSQLYYVS

SEQ ID NO: 1091 - protein, 525 aa, Sanguinaria canadensis
MDSTLVFIGLFALLLVYPLLLRRSVLKSTSNTNKTTYKSKNQAPEAAGAWPIIGNLHQLAGGGNCLHKTLGAMADKHGPAFTIRMGLHKALVVSSWELAKECFTTNDVVFMSRPHQVAIKHMGYSTAMFGIAPYGPYYREMRKIVTQELLSNRRLELLKHVWASEINNSIKQLYEKVEGGPVLIEMKRWFADLTLRTTVKVICGQQQFGGDDDDDEAGRFQTALRDFFRLLGHFRVADVIPVLEWLDFQGYKKEMENNGRVLDNLMNKWLEEHKRKRKNGGTEEDFMNVMISKLLDDTKMLSYYDADTINKSTCLTLILGGSDTTMVSLTWALSLLVNHPHVLKKAQEELDVHVGKERQVDDSDLWSLTYLQAIIKETLRLYPPGPLSAPRESTDNCTIAGYHVPAGTRLIVNTWKIQRDPRVWPDPLEFKPERFLTTHVDVDVKGQNFELLPFGSGRRACPGASFALRVLRLSLARLIHGFDFKTPLDDSPIDMVESGGITNVKDTPLEVLVTPRLPSSLYVCK

SEQ ID NO: 1092 - protein, 532 aa, Sanguinaria canadensis
MDFDLYQFSKPTIFIGGLFAILLYFVLKKSSTPKSKSKLEQPPEPAGAWPIIGHLPLLGGPDLPHITLGKLADKYGPAFTIRIGVHKAVVINSWEVAKECFTTNDKAFSSRPRQVAMKHMGYDYAMFGFAPYGNYWRELRKIVNREVLSHSRIESLYHVWGTEINTSVKELYELWGKKSTGSGGAPVLVEMKRWFSDMTLNMSVMMVAGKRYNFSGNKADDEAGRCQDGLRNFFRLVGLFVPSDALPFLAWLDIGGYEKEMKKVAKELDVLVQEWLEEHKEKRLALTAAGKKGSENDFMDVMMNILEDQKLSEFDADTINKATCLTLILGGTDTNMVNLVWALTLLVNNQDALKKAHDELDFHVGKDRQVEESDVKNLVYIQAIMKETLRLYSGPLSGLRESTEDCTVAGYYVPAGTRLIINAAKIHRDPRVWSDPTAFKPDRFLTEQKEMDVRGQDFEILPFGAGRRICPGVSFALQVLPLALARLIHGFDFKTPTDAPIDMTESPGLTNAKSTPLEVLVSPRLTSKLYGC

SEQ ID NO: 1093 - protein, 555 aa, Sanguinaria canadensis
MDSILNQFISKPTMVICSLFALLSLYFLLIKRSTTKSKLQLPPEPAGAWPVIGHLHQLGGPNLPHITLAAMADKYGPIFTMKIGTYRALVVSSPEVAKEIFTTHDRIWATRPNQAAMKHLGYDSAMFGFAPYGPYWRELRKLVNRELLSNTRLDLLHHVWDSEINTSIKELYDSLATKNNAKGRGTGGAGSTGPVLVEMKRWFADLTLNITVRMVAGKRYFGANKTSSTSTDQCDNEKGDSKAWKCQRELRNFFRLVGLFVVSDALPFLGWLDLGGHEREMKNTARELDVLVQGWLDEHKRKRSLSVAEGGEKINGEQDFMDMMLSTIDDAKLSGYFDADTINKSTCLNLILGGSDTMMVNLIWPLTLLVNYPDELKKVYDELDTHVGRDRQVDESDIKNLVHLKAVIKETMRLYTGRITGLRQSSEDCTVAGYHVPAGTRLIVNTWKISRDPRYWSDPLEFKPERFLTTHADIELTGQNFELIPFGSGRRSCPGASFAIQLLHLALARLVHGFWFERPSDAPIDTSECPGLTNFKATPLEVLATPRLPSKLYVG

SEQ ID NO: 1094 - protein, 538 aa, Sanguinaria canadensis
MDFILNQFISKPTMVLGTLFALLSLYFLLIKRSTTKSKLQLPPEPAGALPIIGHLHLLGGPNPPHITLANMAEKYGPIFSIKMGLKRALIVSSSEVTKECFTTHDLNFVSRPRHAAMKLMGYNFATFGFAPYGPYWRELRMIINRELLSQTRILSLEHVWGSEINESIKELYDLLTRKGGGGGGPVVVEMKRWFADLTLNIAVKMVCGKRYFGVNSPSTSTTRDVQEDDEARRCQKGMRNFFRLLGQFVVSDSIPFLGWLDLGGYQREMKNTARELDDLMQGWLEEHKKKRLERKTAAGEQDFMDVMLNILEDGKLSQYFDTDTINKSTCLSLILGGSDTTMVNLVWAFSLLVKHQDALKKTRDELDIHVGRERQVEESDIKNLVFLQAVVKETFRLYAGPISGVREAAEDCTIAGYHVPAGTRLLINSWKIHRDPRVWSDPLEFHPERYLEARHADIDVKGQNFELAPFGMGRRVCPGSAFGLQVLHLTLARLIHGFEFKTPSDAPVDMTESVGMSIIKATPLEVLVTPRLPSELYV

SEQ ID NO: 1095 - protein, 533 aa, Sanguinaria canadensis
MDISNLYELYYFSTPTLFVGGLFVLLLIYSLFSSRPGIKSKLQQPPEPAGAWPLIGHLPVLSGPELPHVALGKLADKYGPVFTIRMGVHKSLVVSDWEVIKECFTTHDKVFSSRPCQVAMKLMGTAMFGFSPYGNYWRELRKIMNREVLSHGRIESLYHVWGSEINTSVKELYDLWAKKNNGGGPILVEMKRWFSDLTLNMSVMMAAGKRYNFGDDSSTTNDEAARCQHALREFFRLVGLFVPSDALPYLGWLDIGGYQKQMKKVARELDDLMQVWLDEHKKKRLAAKAEGKKGGEQDFMDVMMTILEDGKLSDYYDADTINKATCLTLILGGTDTNMLSLVWTLALLMNNRQALKKVHEELDIHVGRERQVEESDIKNLVYLQAVIKEEMRLYSGPLSGLRETTEDCTIAGYHIPAGTRLIINASKLHRDPKVWSDPLEFKPERFLTENVGVDVRGQNLELQPFGAGRRICPGVSFALQVLPLTLARLIHGFELNTPGDAPIDMTESPGLQNAKLTPLEVLITPRLPSKLYV

SEQ ID NO: 1096 - protein, 535 aa, Sanguinaria canadensis
MIVIGAFLALVVLVVYYNLLLRRPALLKFKNMKQQAPEAASAWPIIGHLHNLAGGIGGNGLLHEKLGAMADKHGPAFIIRLGLHKALVVSSWEVVKECFTTNDVALISRPHQVASKHMGYGMAMFAFASPYGPYWRELRKIVKQELLSNSRLELLKHVWASEINTSIKQLYEKVKEGGGLPVLVEMKGWFADLTLKMTVKVICGKRHFRVAGNVGDHVDADDDDEVIGGRFEKALRDFFRLLGDIRVVDVLPFLRWLDFGVGYKKEMENNGRVLDILMEEWLQEHKRKRMNGGTEEDFMNVMISKLLNDTKLLSYYDADTINKSTCLTLILGASDTTMVTLTWALSLLVNHPQVLKRAQDELDVHVGRERQVEDSDIQNLTYLQAIIKETLRICPPGPIQAPHEAKDDCTVAGYHVPAGTRLIVNTWKIQRDPRVWPNPSEFKPERFLTTHVGVDVRGHNFELIPFGSGRRSCPGTSFALQVVHLTLARFIHGFEFKTPSDAPIDMTESGRITNVKATPLEVLVTPRIPPSGLYV

SEQ ID NO: 1097 - protein, 572 aa, Sanguinaria canadensis
MDLLIFSSQLQGTVGLLALLTFSYYVWILIIKRIKTTNTLKVMNKVAAAAAPEVAGAWPIVGHLPQLVGPQQLYRILGDMADEYGPIFMVRFGMYPTLVVSSWEMIKECFTTNDRFLASRPSSAAGKYLTYDFAMFGFSFYGPYWREIRKISTLELLSHRRLELFKNVPFTEIDTCIKRLYQLWRVKNNDHPAAAPVIKVDMSQLLRDLTLNTILKLVVGKNLFNEKDHGEQEEGRKLHLHKTIVEFFKLAGVSVASDALPFLGWLDLDGQKKKMKRIAKEIDLIAERWLQEHQEKKSLSNKKLLAAGGGKVDGHDDFMDVLLFILDDDSQFFNFSRDTVIKATSWAMILTAADTTSVSMTWALTLLLTNPRVLRKAQDELDMKVGRDRHVEERDIENLIYLQAIVKETLRLYPAAPLGVPHEAIQDCTVAGYQVRAGTRVLVNLWKLHRDPRVWSNPSEFRPERFLIDDIDEQGGGGGGGGGESTAKDFRGQHFEYIPFGSGRRMCPGINFALQIVHMTLARLLHAFELRTTTSASLMDMTEESGLTMPKKTPLVVLLQPRLPLPLYDHHE

SEQ ID NO: 1098 - protein, 533 aa, Stylophorum diphyllum
MEFLSLQHQLISIFALLLASIFLYNLLKNHGRKSKTSKPPAPEASGGWPIMGHLNLFNGSELTHQALGSMADKYGPAFNIRFGSHQTLVVSSSEIVKECFTTNDRFFSNRPGSLAIKLMFYNADSVGYAPYGAYWRDLRKISTLKLLSNHRLETLKHLRTSEVESCFKQLYNQWKNNKVGGDHDFALVRMDNWFGDLTFNVVARIVAGKKNFAGGATNGDVGAQRYKEAMDEAFRLMTIFAFSDVVPSLGWLDKLRGLVGGMKRCGAEIDSIVAGWVDEHRLKRASGKGGGHTDLEQDFIDVCLEIMEHSTLPGDDPEIVIKSTCLDMILGGSDTTTVTLTWALSLLLNNPHVLKRAREELDTHVGKDRQVDDSDMSNLVYIQAIIKETMRLYPAGPLIERRTSEDCEVGGFHVPAGTRLLVNLWKMQRDGSVYKEDPLEFRPERFLTSNADVDLKGQNYELIPFGAGRRICPGVSFAVQLMHLVLARLVHGFEMKTAGDAKVDMTESAGLISHKVTPLEVLLKPCLAIQQAL

SEQ ID NO: 1099 - protein, 533 aa, Stylophorum diphyllum
MDSFLLIQWFAASMAALLAFVFLYNLVWSSSRTTKGKNIRKAPMAAGAWPILGHLHLFGSGELPHKMLSTMAEKYGPAFTMKFGKHTTLVVSDTRIVKECFTTHDTLFANRPSTTAFDLMTYANDSVAFTPYGPYWRELRKISTLKLLSNHRLQSIKEIRVSEVNVCFRELYESCKSKTDATPVLVDMKKWFEEVSNNIVMRVIVGRQNFGSKIVQGEDEAVNYKKVMDELLRLASLSMLSDVAPVLGWLDMFQGNKSAMKRNAKKVDTILEGWLEEHRMKKSASGISSAGENDQDFMDVMLSIIEETKLSGRDADTVIKATCLAMIMGGTDTTAVSLTWIVSLLMNHRHVLKKAREELDALVGKDRQVEDSDLKNLVYMNAIVKETMRMYPLGAMLERETKEDCEVGGFQVQGGTRLLVNVWKLQRDPNVWTDPTEFKPERFLNENADIDVGGQHFELLPFGAGRRACPGVSFALQFMHLVLARLIHGYELGTQNDADVDLTESTEGHVNHKASPLDLLLTPRLNNPNLYDY

SEQ ID NO: 1100 - protein, 568 aa, Stylophorum diphyllum
MTIGALALLSFIYFLRVSVIKRTKYTNTAVTATNKLENDEDEANHSKRVVAPPEVAGAWPILGHLPQLVGLKQPLFRVLGDMADKYGPIFIVRFGMYPTLVVSSWEMAKECFTTNDRVLASRPASASGKYLTYNYAMFGFTNGPYWREIRKISMLELLSHRRVELLKHVPSTEIDSSIKQLYHLWVENQNQNKQGDHQVKVDMSQLLRDLTLNIVLKLVVGKRLFNNNDMDHEQDEAARKLQKTMVELIKVAGASVASDALPFLGWLDVDGLKRTMKRIAKEIDVIAERWLQEHRQKKLTSNDKGGSNNIQGGGGDNDFMDVMLSILDDDSNFFINYNRDTVIKATSLTMILAGSDTTTLSLTWALTLLATNPGALRKAQDELDTKVGRDRQVDERDIKNLVYLQAIVKETLRMYPAAPLAIPHEATQDCIVGGYHVTAGTRVWVNLWKLQRDPHAWPNPSEFRPERFLAVENDCKQQGTCDGEAANMDFRGQHFEYMPFGSGRRMCPGINFAIQIIHMTLARLLHSFELRVPEEEVIDMAEDSGLTISKVTPLELLLTPRLPLPLYI

SEQ ID NO: 1101 - protein, 527 aa, Stylophorum diphyllum
MAALLPLAFLYNIFLASSSKATSKRTISTKKPPMVAGAWPILGHLHLFKEGELPHQMLKSMADKYGPAFLMKFGQHQSLVVSDYRIVKECFTTNDTLFCNRPSTTAFDVMTYANESVAFTEYSPYWRELRKISTLKLLSNNRLQAIKNLREEEVDVSFKGLYDSWKNKNNKSTAGSVGDERAPVLVDMKKWFEEVSNNVVIRVIVGKCNFGTKIVQGEKEGVEYKTIMDELLRLASLSLLSDFAPILGLLDFFQGHVRTMKRNGKKLDVLLQRWLEEHKRKKSTPEDEQDFMDVMLSIIEESKLSGYDADTVIKATCLAMIMGGTDTSAVSLTWIVSLLMNNRQALKKAREELDAQVGKDRQVEDSDLKNLVYLNAIVKETMRLYPLGTLLERETKEDCEVGGFHLEGGTRLLVNVWMVQRDPDVWTDPTKFIPERFLTEKADIDVGGGNFELIPFGAGRRVCPGVSFALQFLNLVLARLIHGYELGTPEDADVDLTESPEGHVNHKASPLELLLTPRLSNPKLYDY

SEQ ID NO: 1102 - protein, 547 aa, Stylophorum diphyllum
MDSDHQLLSYQFSASNMFISLFAFVLYYLLVWRPTKSNLKMKTISSEDKQAPELAGSWPVIGHLHLLHGPNPLHVALGAMADKYGPAFTVRVGVHRTLVVSSWEVAKECFTTNDKVFVSRPRQAAGKHMGYNNAMLRFASDTPYWTQIRKMLKRDLLSNNRIELLNHAWHSEINTSIKELYEMNWSSGEGRRGGIRPPVSVDMKQWLGDLTLNMSVKMIAGKRCFGSGVSACDEGEARRCQKGLKDFVRLMGQIVVSDAIPFLGWLDLDGYEGEMKRAGKELDRLLGGWLEEHKMKRSPGDEASAQKDWMDLMLSVLGDGKLDGYYDADTINKATCLALLQGGSIWTMLTLLWAFALLVNHPHVMKKAHDELDNHVGRERQVEESDIKNLTYLQAIVKEAMRLYSVSMRLLESTADCTVSGYDVPAGTRLIVNTWKIQRDPRVWSDPSEFHPERFLTHRHRDMDLYGQNFEITPFGSGRRSCPGSSLGLQMVQLTIARLLHGFEFKTPSDAPIDMTESVGVENMVKATPIEVLLTPRLLDEVYAFYN

SEQ ID NO: 1103 - protein, 561 aa, Stylophorum diphyllum
FCQFQGIVGILLAFLTFLYYLWRASITGLRTKPKHNDFKVTKAAPEADGAWPIVGHFAQFIGPRPLFRILGDMADKYGSIFMVRFGMYPTLVVSSWEMAKECFTTNDRFLASRPASAAGKYLTYDFAMLSFSFYGPYWREIRKISMLELLSHRRVELLKHVPSTEIDSSIKQLYHLWVENQNQNKQGDHQVKVDMSQLLRDLTLNIVLKLVVGKRLFNNNDMDHEQDEAARKLQKTMVELIKVAGASVASDALPFLGWLDVDGLKRTMKRIAKEIDVIAERWLQEHRQKKLTSNDKGGSNNIQGGGGDNDFMDVMLSILDDDSNFFINYNRDTVIKATSLTMILAGSDTTTLSLTWALTLLATYPLCALRKAQDELDTKVGRDRQVDERDIKNLVYLQAIVKETLRMYPAAPLAIPHEATQDCIVGGYHVTAGTRVWVNLWKLQRDPHAWPNPSEFRPERFLAVENDCKQQGTCDGEAANMDFRGQHFEYMPFGSGRRMCPGINFAIQIIHMTLARLLHSFELRVPEEEVIDMAEDSGLTISKVTPLELLLTPRLPLPLYI

SEQ ID NO: 1104 - protein, 522 aa, Tinospora cordifolia
MDLPQPTISTTLLAFFSILLFIICYRLLSTKSDKRSSSSRNKPLDAPGAWPVIGHLHLLNGVIQHEILGTMADKYGPAFTIWLGTRPALVVSNWEVAKECFTTCDKALASRPPSLALKIMGYNDALFAFAPYGQYWRELRKIVMIELLSSRQLDSLKHVWDSEIDSCIEDLYEKCKGHRETVLVNMKQWFADLMMNVVVRMVVGKLNFGKTKEGDDEVAKAHQGQLKAMREFFKWVDVFMIEDAFPILTWLDPQGYQRKMKNIAKDLDSLVQGWLDEHKLKQKTGDNGKKDFMDIMLSAVKDASISDRDDETICKATCLNIILGASDTTTVTLTWTLSLLLNNRHVLRKAQEELQAQVGKHRCVEESDVKNLVYLHAIIKEVLRLYPAVPLLGPRESVADTVVAGYHIPAGTRLIVNLWKIHRDPLNWPDPLEFRPERFLTTHKDTDVWGQNFELTPFGSGRRICPGISFALQVIPLTLARLLHGFELTTPGSAPVDMTESTGLTNLKATPLDVFISPRLVL

SEQ ID NO: 1105 - protein, 526 aa, Tinospora cordifolia
MESIPTAINVLLAFVSIYYLLKFRKKIITTTRDIKKIKAPELKGAWPIIGHLHLFRSDDLLHRKLGAMADELGPAFMIRLGMRPALVVSNWQTAKECFTTKDRIFATRPDSVAAKHMGYENLILGFTRYGPYWREVRKIVTLELLSSHRLHLLRHVRISEIDMSIKKLHQLCTSNDNKYSSVVVDLNQWFKALTLNIIVRIIAGKRYYGGDLEDDEESRRWKKALNEFMHLFGIFSVSDAIPQLQGMDVQGHERVMKRTGKDIDVILSKWLEEHRRKKIRVNREGAEKDFIDIMLDLIKENVNISGHDADNVVKATCLALVSAGSDTTMITLTWAVSLLLNNHRVLEKAQAELDNQIGINRVHVEEEDIKNLPYLQAIVKETLRLYPAAPFSLPHEAMEECTVAGFHVPKGTRLITNIWKLQRDPQVWEDPLEFRPERFLTSDRRHVDFRGQHFELIPFGSGRRMCPGISFAIGVLHLTLARLLHEFHLGTPTNAPIDMNENPGITLEKADPLHPLVSPRLTSINY

SEQ ID NO: 1106 - protein, 538 aa, Tinospora cordifolia
MDSQLTSFQSKPSAYLIAALLALVSAYYLIIKKKSRATYQDNYGKIRAPEPKGAWPIIGHLLLFKPNDVLYQKLSSLADELGPAFMIRLGMRSALVISNWEIAKECFTTNDRIFATRPKLMASKHMGYGGAEVGVAPYGPYWREVRKIITVELVSNHRLNLLKDVRISEIDMSLKELYDLCMKKKKNGSGEESSRVELDLYQWFKDMSLNILVKLIAGKRYYGVAAAANEDEESRRWKKATEESVFLFGQFVVGDAIPLLEGVDVQGLERAMKKTGKEIDAVLSKWVEEHRMKKQQLNGARDEQDFIDVMLNIIKDGKISDHDADTIVKATCMSLVQAGSDTTMLTLTWAVCLLLNNCNVLEKAQAELDDQIGRSKGRIVEEDDIKKLPYLQAIVKETWRLYPPAPLAVPREAMEDCTVAGFHVPKGTRLMTNIWKLHRDPKVWDDSLKFRPERFLSSEHAHVDFRGQQHEFMPFGSGRRMCLGMPLAIGVVHLTLARLLHEFELATPSNAPVDMSEKAGLTLVKATPLNVLIAPRLC

SEQ ID NO: 1107 - protein, 531 aa, Tinospora cordifolia
MDSIILQSNLLTTVIIITSFGLFVLSFYYVLWKAIRTGNKRNCSNPKAPEAAGGWPILGHLHLFRGQGLLLHKIFGAMAEKHGPAFTIRLGMRPALVVSNWEVAKECFTANDRALASRPTSLALKIMGYNNSLFAFAPYGQYWRELRKIVMHQLLSSRRLELLKNVWLSEIDIWIKGLYENSLVNKVVDMKQWFGELMMNIVVRLVAGKRSFGKIREGDSEEAKAHQRQIKALRDFFRLVEVFMIEDAFPFLTWLDPRGYQKEMKNIAKELDYLLEEWLEEHKLKQQAACDDQSKDFMDVMLSEVKDSTITERDANTICKATCLNVILGASDTTTLTLTWALSLLLNNRHVLKKAQEELNAQVGKDKQVEESDMKNLVYLHAIIKEVLRLYPAAPLSVAHESLEDTVVAGYHVSKGTQVIFNLWKIQRDPSVWSNPLEFQPERFLTTHKHVDIWGQNFELIPFGSGRRMCPGVPFALQVVSLTLARLLHGFELTTPGGAAVDMTETPGLTNMKATPVEVFLRPDLPHQLYA

SEQ ID NO: 1108 - protein, 524 aa, Thalictrum flavum
MPSQTIQIIMDFFHQCVATILFCVLASPFFFYYLLPWWKNANDHDLAKSRGKPVPEVDGAWPIIGHMHMLQPSDSFYSSLAEKYGPIFTLRIGLCKTIVINSWELAKECCTTHDRVFASSPEATAAKILGYDYAMFGRNPYGPYWREMRKIIITELVSNRRLELLKHIRVTEISTSIQELYQLWEARSSKNVKERVVVDMQKWFGDLMLNIGVEMVAGKRYFGASSNEDKEEARQLHKTFKDFSNLFGVPVLSDAIPFLRWLDYKGHIKAMKRCAKQVDCILHRWLEEHKQNKTTIAGDFMDILLSVLQDKEIFGRDADTVIKATCLNMMLGVVETNKVTVTMALISLLNNRRILKKAQEEIDIHVGSDKQVEESDIEKLVYLQAIVKETLRLYSPGLGTREPSEDCTISGFHVPKGTEVMVNVQQIHRDPSIWSNPLEFQPERFLTTQANIDFGGQHHEYIPFGAGRRLCPAISFAVLVVHLTLARLLQGFDFATPKDAPVEMNESVETLEVLITPRLPLHMY

SEQ ID NO: 1109 - protein, 534 aa, Xanthoriza simplicissima
MHNPIPNQWLPSSTLLTPIIVSFLVIVLFYIYKKRSSNTIRTKKAPEVVGAWPVIGHLNLFSCPKPGHIVLGELADQYGPAFTIHFGMHPTLVVSSSELVRDCFTTNDKLFSSRLVNKAIKYMFYDQDTISFAPYGPYWRELRKMIALNLLNNERIKMLQQQRISEMDACLKKLYDLSAKRKDENAGVLVDMSKWFAEISFNVVTRIVAGKHIFGPKVERYKNVMEEARRLMDVMVFSDMVPYLGWLDRLRGVDSAIKRTAKELDSVLESWVEEHRRKSVSISAGTGGIFNIKEEEELDFIDIMLSIIAKNNLPGDDPDTLIKAIVQETYLAAWDNTTVTLTWVLCLLLNNKQVLKRAQNELDAQVGKERQVEDSDINNLPYVQAIVKESLRLYPPGPIIERATTEDCNVGGFRVPAGTRLWVNLWKLQRDPKVWPNDPLEFRPERFLNDNADIDLRGQNSELIPFGSGRRMCPGVSFSLQVIHLVIARIIQGFELKAPTDADIDMSTTLGMISWKATPLEVLMNPRFPPVFYK

SEQ ID NO: 1110 - protein, 550 aa, Thalictrum flavum
MSTLQISILTVKSPYSQMHYYPLLHQWLPASMALVSLLVIILFSIFKKRSSKMIKAKKAPEVAGAWPLIGHLNLFSGPKLLHLVLGELTDQYGPAFMIHLGMYPTLVVSNWELLKDCFTTNDIFFSNRPVNKAIKHMFYNKESIGFTPYGSYWRELRKMTTLKLLSNHRLDLLKPLRISEMDACFRNLYELWTKDKDGNAWLLVDMSKWFGEISFNVVARIVAGKKNFGSKGDRYKTVMEEVVRLMGLRALSDAVPYLGWLDQLRGLDSAMKRAAKELDSVLESWVEEHRLKRVSVSAGTGSTVKTAKEEEEEEDFIDITLSILAENQLPGDDPDTGIKSLILDMILGGSDTSTVTLIWAMCLLLNNVHVLKRAQYELDAQIGKERQVEDSDIKNLPYIQAIIKETMRLYPAGPIIERQANEDCDVGGFHVPAGTRLWVNLWKLQRDPNVWKDDALEFRPERFLTDHADIDLKGQHLELIPFGSGRRICPGISFALQVMHLALARIIHGFELKTPNDSNIDMSGTPGLLCCKATPLQVLLTPRFNPMFYK

SEQ ID NO: 1111 - protein, 520 aa, Xanthoriza simplicissima
MDSLRHCLGGILALLIFLGYLQWKRGTSNKCIEAPQPDGAWPIIGHLPRLMKPQIMHRTLSTMADKHGPAFTLRLGVHKTLVVSSWEVAKECFTTNDRVFATRPTSIAVEILGYNYALFAFGPYGSYWREARKIAILELLSNHRLELLKHVRISEVSTSIRELYQVWKENCDIANGSALVDMKPWFGDLTLNVVVRMVAGKRYMGGSVKSDDVEGRRFQKATKDLFDLFGLFILSDALPFMGWLDLHGHKKAMKKTAKELDSIMQRWLEEHRQSLLDDGTKEEKKDFMYVMLSILEDKKLFQYDADIVNKAICMNMIMAGTDTQMITLTWVLSLLLNNRHILKKAQDEIDSSVGKDRQVEESDIVKLVYLQAIVKEALRLYPPAPLSAQHEAMEDCTVAGYYVPAGTRLITNIRKIQRDPRVWSDPFEFHPERFLTNQANVDFRGQSFEFIPFGSGRRMCPGISFALQVVHLTLARILQGFDFETPMNASVDMTEAPGLTNVKSTPLQVLITPRLHPNLY

SEQ ID NO: 1112 - protein, 523 aa, Xanthoriza simplicissima
MDLLNPYFATIFGGFFALLIFLFIISQKRSRIPKIRAAPEPVGAWPIVGHLPMLLGPRLPHFVLGDLGEKYGSAFTLRLGIHKTLVVSSWEVAKECFTTNDQVFATRPSFMAAKIMGYNYALFGLAPYGSYWRELRKISIIELLSSHRLELLKHVRVSEVSTSMKELYEVWAENCSNGNGSVLVEMQRWFGDLTLNISVRMVAGKRYFGTSASLDDDEARRISKATKDFFRLTGMFVVSDSVPFLWWLDFQGHEKAMKRTAKEMDDIFGGWLEDHRRNKLAGGTKVQQDFMDVMLSILEDEKFFGYNADVVTKATCLNMLLGGTDTTMVTLTWALSLLLNNRHILKKAQTEINTHVGKDTQVDESDIVKLVYLQAIVKETLRLYPAAPLSTPHEATKDCTIAGYHVTAGTRLITNIWKIQRDPRVWSNPSEFQPERFLTDQANVDVRGQHFEFIPFGSGRRSCPGISLGLLVVQLALARLLQGFDFETPSDALVDMTESAGLTNLKATPLHVLITPRLHSSLY

SEQ ID NO: 1113 - protein, 530 aa, Xanthoriza simplicissima
MDSVHQGQYLPTPMVSVFVFFISLYFLIVWKTRSSSKTNTCNEVPEAPGAWPIIGHLHLLGGSELPHKTLGAMADKYGPIFKIRIGVHQALVVSSSDIVKECFTTNDKVFASRPTSTASKILGYDYVMFGFSPYGPYWIELRKIIMSELLSNRRLELLKHVRDSEIDISIQELYKVWKNHDKSKGPILVDMKQWFGDLALNVILRMIAGKRYSGSIFSSDETEARRCQKGARDFFRLLGLFIIEDALPYLSWFDLQGYKKEMKNTAKELDSVFQRWLEEHKRTRETGELNREQDFMDILMSTLEETKISEYDNDTIIKSTCLSIVTGGNDTTMVTLTWILSLLLNNKHALKKVQDELDSHVGKHRHVEESDIKNLIYLQAIMKEALRLYPAGPLSGPRVADADCTLAGYHIPAGTRLLVNTYKIQRDPLVWSEPSEFRPERFLTSHVNMDVKGLQYELIPFGTGRRACPGMLFALQVVPLVLARFLHEFEPKTEMDMPVDMTETAGLSNAKATPLEVVITPRLQPELYSL

SEQ ID NO: 1114 - protein, 528 aa, Xanthoriza simplicissima
MDFTMIIQWLLTSFAILVAFVLIWSSATRSSTRKRNKTAPVAAGALPIVGHLHMLMGRELPHRLLSNMADKYGPAFMMKYGLQPALVVSSLKLTKECFVHNDRAVFKRPRSKALKNLTYDQASLGFAPYGPLWVEMRKVSKTNLLSNQRLQMQRHVRASEVDAFIKELYDLWSSKSNNIKGAPLLVEMNKWFEELALNVVTRMLSGKRHIGFKARRGEDSESMHYKKVVVDATLLTAKLVVSDFFPSLGLVDYLQGDESSIKGTSKELDAILATWVEEHRHKKVSGSEDDEKDFIDLTLSMIDQTQHQGADVDTFIKSMCVGMIFGGSDSTSVALAWALSILMNNRPVLKKAREEIDRQVGRDRKVNDLDVLKLDYLKAIVKESMRLCLVGPLLERVAVEDCEIGGYHVKAGSRVVVNIWKMQHDPNLWSDPLEFQPERFLTTNANVELRGQHFELLPFGAGSRICPGITFALELIQLTLARLIHGFELGTPMDADVDMTETSSVTNYRATPLEILLTPRLDPKLYNY

SEQ ID NO: 1115 - protein, 504 aa, Argemone mexicana
MEEKIMTNNSPWILTSSTTTTTTILLSLLFTIFIILRRNKSSSSKMVWPTGPKTLPIIGNMNILGGTALHVVLHNLAKTYGNVMTIWIGSWRPVIVVSDIDRAWEVLVNKSSDYSARDMPEITKLATADWKTISSSDSGPFWTNLRKGLQNVALSPQNLSSQSKFQERDIIKTIQNLKEEAKMNNGIVKPLDHLKKAMVRLISRLIYGQDFDNDEYVEEMHHTIEELIRVSGYARLAEAFYYAKYLPSHKKAVREVLQANQRVQNLVRPLLSLNSPTNTYLHFLRSQNYEDEVIIFAIFEAYLLGVDSTSSTTAWALAYLIREPNVQEKLYEELKNFTNDNDRKMVKFEDLNKLQYLQAVVKETMRMKPIAPLAIPHKACRETSLMGRKVNQGTRVMVNIYALHHNQNVWKEPYKFNPERFLQKNQDGVDGKAMEQSLLPFSAGMRICAGMELGKLQFSFALANLVNAFKWSCVSDGVFPDMSDQLGFVLLMKTPLEAGIVPRM

SEQ ID NO: 1116 - protein, 388 aa, Argemone mexicana
MPDITKIISANWKNISCSDSGPFWHNLRKGLQGVALTPLNVASQYHLQERDMKNLINSMYKDASQKNGILKPLDYLKEETVRLLSRLIFGQDFQDENLVVGMHHALDDLVRISGYASLADAFKFCENLPSHKKSIREVHEVKKRVENLIRPHIVSNPPTNTYLHFLKTQDFNEDIIISAILEVYDLGVDSTASTTVWALTFLVREQEIQEKLYREIVNVTGGKRSVKVEDVNKMPYLQAVMKETMRMKPIAPMAIPHKTSKETSLMGKKINKGSVIMVNLYAIHHNPKVFPEPYKFMPERFLKDVNSDESLGNIKTMESSLLAFSAGMRICAGMELGKLQLAFGLASLVHEFKWSCSVDGKLPDLSEDHCFILLMKNPLEAKITRRIH

SEQ ID NO: 1117 - protein, 489 aa, Berberis thunbergii
MEFTVWVVGFNVLVVVAMTMFLLRTKSSSSTTKWPIGPKKLPIIGNLHQLGGDVLHVALAKLAKVHGGIMTIWIGSWRPVIVVSDIDKAWEVLVNKSSDYSARDMPEITKIASASWHTISSSDSGPFWQNLRKGLQNGALGPANISAQSQLQERDMKRMIGDLQKEAKINGGIVKPLDHIKKATVRLLSRLIFGHMFDDDSFIESMHHEIEDLIRISGYARLAEAFSYAKYLPSHKLAVKEAYEVKHRVEQLVRPLLTSSPPANSYLNFLLSQDYSEEVIIFCIFEIYLLGVDSTSSTTTWALSFLIHEQQVQEKLYQSIKGVTSDDDGLVKAEDLSKLQYLQAVMKETMRIKPIAPLAIPHKASKDTKLMGTKVAKGTRVMVNLYALHTKENIWSDPEKFKPERFLHGDEGANVKAMEQCFLPFSAGMRICAGMELGKLQFSIALANLVKAFKWTSVVDGELPDMSEELSFVLLMKTPLEARIIPRHL

SEQ ID NO: 1118 - protein, 501 aa, Corydalis chelanthifolia
MVNAVAEILTEKPWLLPATLLAVIAIAKFFLGKSSTMKWPIGPKTLPIIGNMHQLGGTDLQVVLANLAKTYGTIMTIWVGSWRPMIVLSDIEKAWEVLVNKSSDYSGRAMPEITEIISAKGKTISTSDSGPHWSNLRKGLQNVALSPHNIAAQSRFQESDITKMIKTLKQEAASNNGIVQPLDHLKKSTVRLISRLIFGQDFDDDEYVEAMHLAVEELIRVSGYARLAEAFYYAKYLPSHKRAVSEVWEANRRVKRIVKPRLSANPPPNCYLHFLSSQDYSEEMIIFAIFEAYLLGVDSTSSTTAWALGFLIREPKVQERLYQELKNCAGENGLIKVEDINKLPYLQAVLKETMRMKPIAPLAIPHKAVRETSLAGNKVEPGTRVMVNLYAIHHNPKVWIDPHKFKPERFLQGEENGGGNLKLMEQSLLPFSAGMRTCAGMELGKLQFGFSLANLVNAFQWDCAKKGMFPDMSDLLGFVLLMKTPLQAKIVPRGSPSINGY

SEQ ID NO: 1119 - protein, 503 aa, Corydalis chelanthifolia
MVAAVVEILKEKAWLLPTTLVAIIAIAKLFLAKSSTVKWPTGPKTLPIIGNMHQLGGTELQVTLTRLAKTYGNIMTIWVGSWRPMIVVSDIEKAWEVLVNKSSDYSGRAMPEITQIGSANWKTISTSDSGPHWSNLRKGLQNVALSPHNIAAQSRFQESDISKMIKALKQAAVANNGIVLPLDHLKKTTVRLISRLIFGQDFDDDEYVEAMHLAIEELIRISGYARLAEVFYYAKYLPSHKRAVDSAWEVNRTVKRIVKPLLLVKPPTNCYLHFLTSQDYSEEVIIFAILEVYLLGVDSTSSTTAWALGFLIREPRVQEKLYQELKNFAGENGMIKVEDINKLPYLQAVLKETMRMKPIAPLAIPHKAVRETSLAGNKVEPETRVMVNIHAIHHNPEVWMDPYKFKPERFLQGEDINGGGNLKLMENSFLPFSAGMRICAGMELGKLHFGFSLANLVNAFQWDCAKKGKLPDMSDLLGFVLFMKTPLEAKIVPRGSSSNINGY

SEQ ID NO: 1120 - protein, 490 aa, Corydalis chelanthifolia
MEESFWIVSATIVVVFVIATMFRKSSSISSKTEWPAGPKKLPVIGNLHQLGGDVLHVVLANLAKVYGTVMTVWVGSWKPMIVISDIDRAWEVLVNKSNDYSGRDLPEITKIISANWKNIMTADAGPYWTSLRKGLTGHTLAPTNVASQSHLQEKDMNNLINRMKNQAASNNGIIKPLDHLKEETVRLLSRLIFGQHFEDEHFVEGIHQALDDLVRISGYASLADAFKFCENLPSHKKSISGVHEILSRVRNLVRPYIVPNPPTNTYLHFLQSQKFTEEVIIACILEVYDLGVDSTAATTVWALTFLVREPEVQEKLYREIQTVIGDRGTVKVEDISKMTYLQAVMKETMRMKPIAPMAIPHKAVRETTLMGNKIDKNTVVMVNLYAIHHNPKVFPEPYKFRPERFLAGGDGKFGNLKAMEQSLLPFSAGMRICAGMELGKLQYGFALASLVNAFNWTCTADGKLPDMSEDHCFILLMKNPLVARIIPRVN

SEQ ID NO: 1121 - protein, 495 aa, Chelidonium majus
MEEINVEWISTAATTIGIIVVVFATVSMMFGRRRKSSMKWPNGPKTLPIIGNMHQLGGTALQVVLHKLADVYGSVMTIWIGSWRPVIVVSDIDKAWEVLVNKSSDYSARDMPEITRINTANWSTISTSDSGPHWSNLRKGLQNVALSPLNVAAQSQFQEKDINQVIKNLQEESALNGGIVKPLDHLKKATVRLLSRFIYGQNFDDDTYVENMHNEIEELIRISGYARLAEAFYYAKYLPSHKKVEKAVEEAHYRVKALISPFLTRNPPPNSYLHFLRSQNYPEEVIIFCIYEVYLLGVDSTSSTTAWALAYLVRESAVQEKLYQELNNFIGDRQQMGSAIKVEDVNKLQYLQAVMKETMRMKPIAPLAIPHKACKDTSLGGNKVDKGTKVMVNLHAIHHNPKVWNEPNRFKPERFLQLKDKKEMEQSYLPFSAGMRTCAGMELGKLQFGFALANLVYAFQWSCVADGKPPDMSDLLGFVLFMKTPLEARIVPRVR

SEQ ID NO: 1122 - protein, 490 aa, Chelidonium majus
MEESFWLVAATVLVVFVVAKLLFRKSSSISTMEWPAGPKTLPIIGNLHQLGGAALHVVLANLAKVYGSVMTIWVGAWRPMIVISDIDKAWEVLVNKSSDYSARSLPEITRIISANWKNIMTSDSGPFWQNLRKGLQGGALSPHNVMSQYQLQERDMQNLIKTMRVEASKNNGRIKPLDHLKQETVRLLSRLIFGQDFNDEKLVVGMHHALDDLVRISGYASLADAFKVAENLPSHKKSIREVHELKRRVENLVRPHIVSNPPTNTYLNFLLSQNFSEDLIISAILEVYDLGVDSTASTTVWALTFLVREQKVQEKLYQEIKNLTGGRSTVKVEEVSKMPYLQAVMKETMRMKPIAPMAIPHTAARETSLMGKKIDKGTVVMVNLYAIHHNPNIFPEPYKFMPERFLHGEEQNGGNIKEMEQSLLPFSAGMRICAGMELGKLQLGFALASLVNAFKWECAADGKLPDLSEDHCFILLMKNPLEAKITPRTH

SEQ ID NO: 1123 - protein, 501 aa, Chelidonium majus
MEGSLWIILSILVGAVMILVQNLWKRWSKTSEDMILPPGPRKIPIIGNLYQLNRGGELIHVALAKLAQEHGKMMTIWFGGGQPSIVVSHHEVAWEVLVTKAADYSSRTLPFMSRVTSADWHTLATSNLGPFWQTLRKGLRSTTLNPHTISAQVQLQEEDVTRMILSFKEQACLNDGVVKPLIPLRRTTVQLIGRFCFGPEFKNDDDFVEEMDIVIEDVISLTGHGRLIDIFEFTRYIPGLNLPFKQAYKVKQRIIELIRPYIDYHKSSKSPCPNCYLHFLLSHDYDEEVITFNLFELFLLAVDSTSNATAWALAYLIHDQKIQQKVYDEVSEFGRKEMVTIEEVSKLKYVNAVVKEIIRMKPIAPLAVPHQADRDSKLMGIQVKKGTPVLVNLYAMHYDPSIWIEPSRFMPERFLVGHPQNVHCGEDHMAVMERSLIPFGAGRRICAGMDLAKLQVALTIANLVNSFQWSSAVEGQLPDLTEDLTFILRMKTPLAARIIPR

SEQ ID NO: 1124 - protein, 487 aa, Cissampelos mucronata
MDQTNILLAVAAALFIGLLTKLLASNSKHHLPPGPKPLPIIGNMLELSKGGELLHVSLAKLAERYGEIMSFWFGGFEPSIVVTSHELVWEVMVTKANDFSDRALPWLTKILTSNWQTLATCDLGPYWYSIRKGLQSTTLNHQTIMSQTQLQERDIADLLTSLEQEASSNNGIVKPYPMLRKLMVRLVSRFCFGPDFPNDEEFVERMDSTLDESIHQSGHTRLADLFEFTRYVPGLWGPFKESESLKRRIVNLLTPHLKAASSPNCYSSLLLSKGLSEEVVVLNLYELFELAVDATSNTTAWALAFIIHNKDAQEKVFKEVRYNQVGERRKIIRVEELGEMEYVQAVAKETIRMRPIAPVMPHKAARDGELKGVKVRGGTPVLMNFYAVLHDEKVWREPYKFTPERFTTKGVDAEAMERSYVSFGVGRRSCPGMELAKIQIAVTVANLVNRFEWCSAAEGELPDLSEGLTFVLMMKTPLVARIVPRSY

SEQ ID NO: 1125 - protein, 502 aa, Cissampelos mucronata
MDVHYSTLLIALATLASLLLLSKLLLRSINTSKHHQWPPGPNKLPLIGNLHQFRGDLLHQNFAELAQKYGKLMTVWIGSQQPFIVVTDPDLAWEVLVTRAVDYWSRQMLYLSRIISAGNRTLATSDGGPYWETLRRGLQSTALSPQTISSQTKLQEQDIAHMIASLQQEASLNDGLVKPLPHIRKLAIRLLARLCFGADFPNDEHFVERMDELLEDDMRLLTAAGLVDVFEFTRHIPGLTPRLKEIEDHMEGIKGLIRPCLAAAMKKKGNSISLGNTHMNFLISQGFTEEIIILNLFEVFVFGVDSTSISLSWALGFLIDGRETQEKVLKEIVSKLGGSRRVVGVGDVSGMEYVHAVVKETLRMRPVAPMAVPHKAARDSELMGFKVKEGTPFFVNLYALHHNEKAWKDANKFVAERFVKGDGAEEYLKKMERYYIPFGAGRRACPGMELAKVHLAMVVANLVNSFEWQSAVEGQPLDLSETLNPLLVMKTPLVARLVPRFA

SEQ ID NO: 1126 - protein, 495 aa, Eschscholzia californica
MEEMKILMMNNPWILTATATTLLISIFLFFTRKSSKMVWPAGPKTLPIIGNMHLLGGTALQVVLHNLAKVHGSVMTIWIGSWRPVIVVSDIERAWEVLVNKSSDYSARDMPDITKIISADWKTISTSDSGPHWTNLRKGLQNVALSPHNLAAQFQFQEKDMTKMIQTLEEEARNNNGIVKPLDHMKKATLRLISRLVFGQDFNNDKYVDDMHLAIEELIRVSGYARLAEAFYYAKYLPSHKKAVREVEEAQRRVQNLVSPFLSLNPPTNTYLHFLRSQKYDDEVIIFAIFEAYLLGVDSTSLTTAWALAFLIREPNVQEKLYQELESFASKNDRKILKVEDINKLQYLQAVIKETMRMKPIAPLAIPHKACRDTSLMGKKIDKGTRVMVNIFALHHNKNVFNDPFKFMPERFMKVDSQDANGKAMEQSLLPFSAGMRICAGMELGKLQFSFALANLAYAFKWSCVADGVLPDMSDQLGFVLLMKTPLEARINRRN

SEQ ID NO: 1127 - protein, 495 aa, Eschscholzia californica
MEEIKILIMNNPWILTATATTLLISMFLFFTRKSSKMVWPQGPKTLPIIGNMHLLGGTALQVVLHNLAKVHGSVMTIWIGSWRPVIVVSDIERAWEVLVNKSSDYSARELPDIIKYNTADCRTIATCDSGPHWSNLRKGLQNVALSPNNLAAQFQFQEKDVIKMIDILEQEAINKNGIVKPLDHLKKATIRLISRLVFGQDFNDDKYVEDLHQAIEELIRMSGYAQLAEAFYYAKYLPSHKKAIRHAELTKQIVTNLVRPFLSLNPPTNSYLHFLQSQKYDEEMVIFAIFETYLLGVDSTSSTTAWALAYLVREPNVQDRLYNELNNYAKYNDRKILKVEDINKLQYLQAVTKETMRMKPIAPLAIPHKACRDTSLMGTKIDKGTKVMVNLHALHHNENVFTDPFKFMPERFLKVNNEDVNMKAMEQSLLPFSAGMRICAGMELGKLQFSFALANLIFAFKWSCVDDGVLPDMSDELGFVLLMKTPLKARINPRN

SEQ ID NO: 1128 - protein, 490 aa, Eschscholzia californica
MEESLWVVTATVVVVFAIAKLLKKSSSISTMEWPKGPKKLPIIGNLHQLGGEAFHVVLANLAKIHGTVMTIWVGAWRPMIVISDIDKAWEVLVNKSSDYAGRDFPEITKIISANWKNISCSDSGPFWQNLRKGLQGGALAPLNVISQYQLQERDMKNLITSMQEKASKNNGILKPLDYLKEETIRLLSRLIFGQSFNDENFVKGVHLALDDLVRISGYASLADAFKFCENLPSHKKSIREVHEVNERVVNLVKPYLVKNPPTNTYLYFLNSQKFSDEVIISAVLEVYDLGVDSTASTAVWALTFLVREPRVQEKLYKEIIDLTGGERSVKVEDVSKLPYLQAVMKETMRMKPIAPMAIPHKTSRDTSLMGKKVNKGTSIMVNLYAIHHNPKVFPEPYKFIPERFLQGQESKYGDIKEMEQSLLPFSAGMRICAGMELGKLQYGFSLASLVEAFKWTCAVDGKLPDLSEDHCFILLMKNPLEARITPRTQL

SEQ ID NO: 1129 - protein, 495 aa, Eschscholzia californica
MEEMKFLIMNNPWVLFATSATLLISIFLFFRRKSPNMAWPEGPKTLPIIGNMHLLGGTALQVVLYNLAKVHGRVMTIWIGSWRPVIVVSDIEQAWEVLVNKSSDYSARDMPDITKIVTADWRTISTSDSGPHWSNLRKGLQNIAISPNNLAAQFQFQEKDIIKMIQILQQEAKDNNGIVKPLDHLKKATIRLISRLVFGRDFEEDKYVEDMHHAIEELIRISGYARLAEAFYYAKYLPSHRKAVRYVEELKQIVKNLIRPFLSLNPPTNTYLHFLRSQNYDEEVVIFAIFETYLLGVDSTSSTTAWSLAYLVREPNVQDRLHQELDHFAKQNDRKILKVEDMNKLQYLQAVIKETMRMKPIAPLAIPHKACKDTSLMGNKINKGTRVMVNLYALHHNKNVFNDPFKFMPERFLKVDNQDAKGKAMEQSLLPFSAGMRICAGMELGKLQFSFALANLIFAFKWSCVDDGVLPDMSDELGFVLLMKTPLKARINPRN

SEQ ID NO: 1130 - protein, 504 aa, Glaucium flavum
MEMKSSVVFSYPAMEELFKSNPWVITGTTLAVLILMTTMFRKKSLSMKWPKGPKTLPIIGNMHLLGGTNLQVILHNMSKVYGNVMTIWIGSWRPVIVVSDIERAWEVLVNKSSDYSGRDMPEITKIISADWKTISTSDSGPHWTNLRKGLQNVALSPHNLAAQFQFQERDICKLIETLKEEAKLNNGIVKPLDHLKKATIRLISRLVFGQDFDNSKYVEDMHHAIEELIRVSGYARLADAFYYAKYLPSQKKAVRDVEEAQRRVQRLVRPFLSLNPPTNCYLHFLRSQNYSDEVIIFAIFEAYLLGVDSTSSTTAWALAFLVREPNVQEKLYQELKNFTAKNGREMLKVEDINKLPYLQAVIKETMRMKPIAPLAIPHKACRDTSLKGRKIDKGTQIMVNIYALHHNENVWKEPFKFMPERFLQTDQDVNGKAMDQSLLPFSAGMRICAGMELGKLQFSFSLANLLNTFQWSCVADGVLPDMSDQLGFVLLMKTPLEARITPRC

SEQ ID NO: 1131 - protein, 490 aa, Glaucium flavum
MVEISVQWILTTSVVVLVFAIASKMFANGRKSSMKWPEGPKTLPVIGNMHQLGGTALQVVLHKLADVYGSVMTIWIGSWRPVIVVSDIDRAWEVLVNKSSDYSAREMPEITRINTANWRTISTSDSGPHWSNLRKGLQNVALSPLNVAAQSQFQERDINQVIKDLQEEAALNNGIVKPLDHLKKATVRLLSRFIYGQNFHDDKYVESMHYEIEELIRISGYARLAEAFYYAKYLPSHKKLEKAVEEAHYRVKALISPLLTSDPPPNSYLHFLLSQNHPEEVIIFCIYEVYLLGVDSTSSTTAWALAFLVREPAVQEKLYQELSNFVGDRQQMGCAVKVEDVNKLQYLQAVMKETMRMKPIAPLAIPHKACKDTSLGGNKVDKGTRVMVNLHALHHNPKVWKEPNTFKPERFLELKDKEMEQSFLPFSAGMRTCAGMELGKLQFGFALANLVNAFQWTCVADGKLPDMSDLLGFVLFMKTPLEARIVPRVR

SEQ ID NO: 1132 - protein, 500 aa, Glaucium flavum
MGRFLAPDIEMEESFWLVTATVIVVFAVAKFFTRSSSISKMEWPAGPKKLPIIGNLHQLGGNVFHVVLANLAKVHGSVMTIWVGSWRPMIVISDIEKAWEMLVTKSSDYSGRSFPEITKIISANWKNISCSDSGPFWTNLRKGLQGGALAPLNVISQYHLQEKDMENLVKSMRVEASKNNGNIKPLDHLKQETVRLLSRLIFGQDFHDEKLVVGMHHALDDLVRISGYASLADAFKIAENLPSHKKSIREVHEVNERVKKLVRPHIVSNPPTNTYLYFLQSQKFSEDVIISAILEVYDLGVDSTASTTVWALTFLVREQEIQEKLYQEIKSVSGGRSTVKVEEVSKMPYLQAVMKESMRMKPIAPMAIPHKAQRETTLMGKKVDKDTVLMVNLYAIHHNPNVFPEPFKFMPERFLQGEDHHNGGNIKAMEQSLLPFSAGMRICAGMELGKLQLAYGLASLVNAFKWDCAVDGKLPDMSEDHCFILLMKNPLEARITPRTH

SEQ ID NO: 1133 - protein, 492 aa, Hydrastis canadensis
MAEIELGLWLGGAVVAIVLSTILFRSSSSSSSFSSQTKWPAGPKKLPIIGNMHQLGGDVLHVALDKLSKIHGGVFTFWIGSWRPVIVISDIDKAWEVLVNKSSDYSARDMPEITKIGSASWHTISTSDPGPFWQNVRKGLQGGAMGPLNMSAQTPFQEKDMKNLIETMKIEAENNNGIIKPLDHIKKNTVRLLSRLIFGQMFEDDKFIESMHYEIEDIIRISGYARLAEAFYYAKYLPSHKRAEKEAFLVKCRVEDLVRPLLKSNPPSNSYLYFLLSQNYPEEVIIFCIFELYLLGVDSTSSTTTWALAYLIREQAVQEKLYQDIKVTIGNANLVKVEDVNKLKYLQGVVKETMRMKPIAPLAIPHKSSKDTTLMGTKVAKGTRLMVNLYALHHNQNIWSEPFKFMPERFLEDGNNNKAMEQSFLPFSAGMRICAGMDLGKLQFAFALANLVNAFKWSCVEEGKFPDMSEEFSFVLLMKNPLEARITPRKAH

SEQ ID NO: 1134 - protein, 465 aa, Jeffersonia diphylla
MTKSSSSWSTMKWPAGPKTLPIIGNLHQLQGDIFHKALAKLAGVHGGVMTIWLGSWSPVIVVSDIDHVWEVLVSKSFDYSARPKPDLIKIVAGDDINISDSGTFWYNLRKGLQNVPLGPVNICAQTNYQEGDIEQMIGDMQEEASSNGGIVKPLYHLKRASTRLLCRLIFGHTFHDDSFVESINNAVEKMIRLGENVHLAEAFSYTKYLPSHKRAVRRSYELKLAIQELVRPFLVSTPPPNTYLYFLLSQHHPEEVIISCIFELFVLGVDSTSSTTTWALAFLIHDQVVQEKLYQEIIQVSNGDCLLRSKDLSKMQYLQAVMKETMRMKPIAPLAIPHITSKHTTLMGTKVAKGTSVIVNLYALHHNPNIWVDPYKFMPHRFLQGQDDVNVKAMEQSFLPFSGGMRICAGMELAKLQFSLALANLVRTFKWTTVLDGNLPDMSEELSFITLMKTPLEARIICRHH

SEQ ID NO: 1135 - protein, 489 aa, Mahonia aquifolium
MEFTVWVVSFNVLVVVAMSMFLLRTKSSSSTTKWPIGPKKLPIIGNLHLLGGDVLHVALAKLAKVHGGIMTIWIGSWRPVIVVSDIDKAWEVLVNKSSDYSARDMPEITKIASASWHTISSSDSGPFWQNLRKGLQNGALGPANISAQSQLQERDIKRMIGDLQKEAKINGGIVKPLDHIKKAAVRLLSRLIFGHTFDDDSFIESMHHEIEDLIRISGYARLAEAFSYAKYLPSHKLAVKEAYEVKHRVEQLVRPLLTSSPPANSYLNFLLSQDYSEEVITFCIFEIYLLGVDSTSSTTTWALSYLIHEQQVQEKLYQSIKGVTSDDDGLVKAEDLSKLQYLQAVMKETMRIKPIAPLAIPHKASKDTKLMGTKVAKGTRVMVNLYALHTKENIWSDPEKFKPERFLHGDEGVNVKAMEQCFLPFSAGMRICAGMELGKLQFSIALANLVKAFKWTSVVDGELPDMSEELSFVLLMKTPLEARIIPRDL

SEQ ID NO: 1136 - protein, 499 aa, Menispermum canadense
MGEGSLWIVATTLVMVGVLIFMMEQSLLWRRRSTQKWPPGPTKFPFIGNLYQLNKGGELVHVTLTKMAQQYGRIMTIWFGSQEPTIVVSDHELAWEVLVTKSSDYSSRTLPYLSRVTSADFHTLATCDLGPYWQTLRKGLQAFTINPHNISSQIHLQEKDIADLVLSLEEEASLNNGVVDPLPKLRRLLILLIRRFCFGPDREFNDDLFVERMDCALEDVIRLFGHARLIDVFEFARYIPGIGLGPFQEVKRLKQRIKELIRPYILAHKSSNSACQNCHLNFLLSQGFTEDVVILNLFELFMLGVDSTSAAIAWALAFVIHEEETQQKLVDEVINKLGRGRRMVGVEEVSELEYVQAVVKETMRMKPIAPLPVPHRAVRDSELKGTKVREGTQVLVNLYAVLTDGRVWKEPNRFMPKRFLQSQRGEDMRAMIMGMERSFIPFGAGRRICAGMELAKPQVALTLANLVYKFQWCSEVEGQLPDLSEDLTFVLRMKTPLVA

SEQ ID NO: 1137 - protein, 496 aa, Nandina domestica
MDPMSLWAAIAIVLVMTLLVLLQTRTKSLPSSSTQWPTGPKTLPIIGNLHQLEGDVFHVALAKLAKMHGDIMTIWIGSWRPVIVISDYDKAWEVLVNKSSDYSARDMPEITKIASAGWRTISLSSSGPFWHTLRKGLQNGPFGPLNVSAQILSQERDMRRMIRDMQEEADINGGIVKPLGHLKKATVGLLTRLIFGQNFDDDSFIESIHHETEELIRISGYARLAEAFSYAKYLPSHRRAVKESYECKHRVEELVKPLLSSNPPKNSYLNFLQSQDYPEEVIIFCIFEIYLLGVDSTSSTTTWALAFLIHEPAVQEKLYQEVKCITNGDGGLVKAGDLSKFQYLQAVMKETMRMKPIAPLAIPHTTSKDTTLMGTKVAKGTRIMVNLYALHHNPNIWSEPFKFMPERFLQEQFNGVGGDANVKAIEQSFLPFSAGMRICAGMDLGKLQFSFALANLVNAFKWTTVADGKFPDMNEELSFVLLMKTPLEARIVPRKP

SEQ ID NO: 1138 - protein, 497 aa, Nandina domestica
MEAISLWTVSASFLTLLALAIILPRTRNSSSIINWPPGPKTLPIIGNLHQLGGQLLHVALTNLAKVHGGVMTIWIGSWRPIIVISSPEEVWEVLVKKSPDYAARDMPEITKLITGYWHTISSSHSGQFWSNLRKGLQNGPLGPLNITTQMSFQERNIKRMISDIQEEATFNGGIVKPLEHLKKATLRLLSHIIFGQSFDDDQFIDSMHHQIEELIRINGFAPLVDAFSYAKYLPSHKRAIKETYRVKNQIEQLVRPVIASSPPANCYLHFLLSQGYSEEVVIYSIVELYSLGVDSTASTTTWALAFLIHDQTVQDKLYQDIKHIAATDALVKIEDLSALHYLEAVMKETMRMKPIAPLAIPHKTSKDTTVRGTKVAAGTCVLVNLYALHHDHKIWAKPHKFMPERFLEGNVNGGDSSGANVKVIEQSFLPFGAGMRICAGMELGKLQFSFALANLVNAFKWTSVVDGKLPDMSEELKFIMLMKTPLEARIIPRNSLN

SEQ ID NO: 1139 - protein, 489 aa, Papaver bracteatum
MIMSNSWILTLISTILSVVFAAVLIIFRRRISASTTEWPVGPKTLPIIGNLHILGGTALHVVLHKLAEVYGSVMTIWIGSWKPVIIVSDFDRAWEVLVNKSSDYSAREMPEITKIGTANWRTISSSDSGPFWATLRKGLQSVALSPQHLASQTAHQERDIIKLIKNLKDEAALNSGTVKPLDHLKKATVRLISRLIFGQDFDDDKYVEDMHDVIEFLIRISGYAQLAEVFYYAKYLPSHKRAVTGAEEAKRRVIALVRPFLQSNPATNTYLHFLKSQHYPEEVIIFAIFEAYLLGVDSTSSTTAWALAFLIREPSVQEKLYQELKNFTANNNRTMLKVEDVNKLPYLQAVVKETMRMKPIAPLAIPHKACKDTSLMGKKVDKGTKVMVNIHALHHTEKVWKEPYKFMPERFLQKQDKAMEQSLLPFSAGMRICAGMELGKLQFSFSLANLVYAFKWSCVSDGVLPDMSDLLGFVLFMKTPLEARVVPRL

SEQ ID NO: 1140 - protein, 494 aa, Papaver bracteatum
MEENSWFITATITVIVVFVLAKFLASKIFSPTTMEWPAGPKTLPIIGNLHQLKGDLFHVVLQNLAKVHGGVFTIWIGSWNPVIIVSDFNIAREVLVSKSLDFSARSVPDYVKIVSAGGKTISESDCGPFWHGLRKGLQGVALNPLHLMSQSHLQERDMQNLIKSMQESASQEDGVIQPLDYIRKATIRLLSRILIGQDFSNEDFVDSMNHTLHKLVSIGGFASLADAFKIGEYLPTHKKFIRELKDVSEEAANLILPYIVSKPSKNTYLHFLVSQEYSEDVIVSAVLEIFGMSSDSTAAATVWALAFLVRHPDIQEKLYQEIKNVTGGNRPVQIVDVKKMPYLQAVVKETLRMKAVGPMGISHKASKNTSLMGKKIDKGTQVMVNHYAIHHNSDIFPEPYNFKPERFFKDVNSDASLGDREKMESSLLPFGAGMRVCAGTDIAKLIISFGIASLVNEFKWSCVSDGKLPDLSEDLSFILLMKNPLEARIAPRVD

SEQ ID NO: 1141 - protein, 506 aa, Papaver bracteatum
MAPINIEENDFWMIACTVIIVFALVKFMFSFYQSANTTEWPEGPKTLPIIGNLHQLGGGVPLQVALANLSKVYGGAFTIWIGSWVPMIVISDIDNAREVLVNKSADYSARDVPDILKIITANGKNIADCDSGPFWHHLKKGLQSCINPSNVMSLSRLQEKDMQNLIKSMQERASQQNGILKPLDHAKEASIRLLSRVIFGQDFSNEDLVIGVKDALDEMVRISGLASLADAFKIAKYLPSQRKNIRDMYATRDRVYNLIQPHIVSNLPANSFLHFLTSQDYSDEIIYSMVLEIFGLGVDSTAATAVWALSFLVGKQEIQEKLYREINNLTGGQRPVKVADLKELPYLQAVMKETLRMKPIAPLAVPHVAVKDTTFKGRRIVKGTKVMVNLYAIHHDPNVFPAPYKFIPERFLKDVNSDGRFGDINTMESSLIPFGAGMRICGGVELAKQMVGFALASMVNEFKWDCVSEGKLPDLREAVSFILYMKNPLEAKITPRDARSYKTFGQ

SEQ ID NO: 1142 - protein, 496 aa, Sanguinaria canadensis
MEFEKIMMSNPWILAATTAVVFISITAIFFRRKSSSMEWPTGPKTLPIIGNMHLLGGTALHVVLHNFAKIYGNVMTIWIGSWRPVIVVSDIDRAWEVLVNKSSDYSARDMPEITKIISADWKTISTSDSGPFWTNLRKGLQNVALSPHNLAAQARFQERDISKMIETLKEEAALNNGIVKPLDHLKKATVRLISRLIYGQEFDNNKYVEDMHHAIEELIRVSGYARLAEAFYYAKYLPSHKKAVRDVEEANRRVKNLVRPFLSSNPPTNCYLHFLRTQNYPEEVIIFAIFEAYLLGVDSTSSTTAWALAFLVREPNVQEKLYQELKNFTTNNDRKMLKVEDINKLQYLQAVIKETMRMKPIAPLAIPHKACKETSLMGSKVDKGTRVMVNIYALHHNQKVWKEPYKFMPERFLETDNQDGNVGKAMEQSLLPFSAGMRICAGMELGKLQFTFSLANLVNAFKWSCVSDGVLPDMSDQLGFVLLMKNPLEARIVPRS

SEQ ID NO: 1143 - protein, 503 aa, Sanguinaria canadensis
MEEMISLQWILTAVIVVVVVAMASKIFSNRRKSSMKWPDGPKTLPIIGNMHQLGGTAGLQVVLHKLADVYGSIMTIWIGSWRPVIVVSDIDKAWEVLVNKSSDYSARDMPEITRINTANWRTISTSDSGPFWSNLRKGLQNVALSPHNLAAQSQFQERDINRLIKNLKEEAALNDGIVKPLDHLKKATVRLLSRLIYGQNFNDDKYVETMHNEIEELIRISGYARLAEAFYYAKYLPSHKRVEKAVEEAHYRIKALISPLLSWNPPLNSYLHFLRSQNYPEEVIIFCIYEVYLLGVDSTSSTTAWALAFLVREPAVQEKLYQELNNFTHDRQMSAVKVEDVNKLPYLQAVMKETMRMKPIAPLAIPHKTCKETSLGGNKVDKGTRVMVNLHAIHHNPKVWHEPYRFLPERFLQVNKETINNGGGGGGTAKEMEQSFLPFSAGMRICAGMELGKLQFGLALANLVNAFQWSCVADGKLPDMSDLLGFVLFMKNPLEARIVPRIR

SEQ ID NO: 1144 - protein, 485 aa, Sanguinaria canadensis
MEESFWLVTVSVIVLFAVAKFFRKSSSIPKMEWPAGPKKLPIIGNLHQLGGDVFHVVLANLAKVYGSVMTIWVGSWRPMIIVSDIDKAWEVLVSKSSDYSARDMPDITKIISANWKNISCSDSGPFWHNLRKGLQGGALAPLNVISQYHLQERDMQNLINSMQQEASKNNGILKPLDHLKQETVRLLSRLIFGQDFHDEKLVVGMHHALDDLVRISGYASLADAFKFAENLPSHKKSIREVHEVKERVENLVRPHIIPNPPTNTYLHFLQSQGFSEDIVISGILEVYDLGVDSTASTTVWALTFLVREQKIQEKLFEEIKKVTGGRSSVRVEEVSKMAYLQAVMKETMRMKPIAPMAIPHKTSKETSLMGRKVDKGSVIMVNLYAIHHNPEVYPEPYKFKPERFLQGSENIKAMEQSLLPFSAGMRICAGMELGKLQLAFGLASLVNAFKWDCAVDGELPDMSEDHCFILLMKNPLQARITPRTH

SEQ ID NO: 1145 - protein, 502 aa, Stylophorum diphyllum
MESLIDFSNPAKMEELMSNPWIITAITLAVVIIMMTIFRRKSSSMKWPKGPKTLPIIGNMHLFGGTDLHVVLYNIAKVYGNVMTIWIGSWRPVIVISDIERAWEVLVNKSSDYSARDMPEITKLISSDWKTISTSDAGAFWTNLRKGLQNVALSPHNLASQFQFQESDIKKLIETIKEEGAVNNGIVKPLDHLKKAMVRLISRLIFGQDFDNDKYVEGMHHAIEELIRVSGYARLAEAFYYAKYLPSHKKAVRDVEEANRRVQKLVRPFLSLNPPTNTYLHFLRSQNYSEEVIIFAIFEAYLLGVDSTSSTTAWALAFLIREPNVQEKLYQELKNFTVKNGRDMLKVEDINKLPYLQATIKETMRMKPIAPLAIPHKACRDTSLMGSKIDKGTRVMVNIYALHHNEKIWKEPFKFMPERFLQTEGEVNGKAMEQSFLPFSAGMRICAGMELGKLQFNFALANLVNAFKWSCVADGVLPDMSDQLGFVLVMKTPLEARITPRC

SEQ ID NO: 1146 - protein, 490 aa, Stylophorum diphyllum
MEESFWLVTATVVVVFVIAKLQFRKSSSISTMEWPAGPKTLPIIGNLHQLGGAALHVVLANLAKAYGSVMTIWVGSWRPMIVISDFDKAWEVLVNKSSDYSARSLPEITRIISANWKNIMTSDSGPFWQNLRKGLQSGALSPHNVMSQYQLQERDMQNLIKTMRVEAFKNNGRIKPLDHLKQETVRLLSRLIFGQDFNDEKLVVGMHHALDDLVRISGYASLADAFKFAENLPSHKKSIREVHELKKRVENLVRPHIVSNPPTNTYLNFLQSQNFSEDLIISAILEVYDLGVDSTASTTVWALTFLVRELKVQEKLYQEIKNLTGGRSTVKVEEVSKMPYLQAVMKETMRMKPIAPMAIPHTAARETSLMGKKIDKGTVVMVNLYAIHHNPNIFPEPYKFMPERFLHGEEQNGGNIKEMEQSLLPFSAGMRICAGMELGKLQLGFALASLVNAFKWECAVDGKLPDMSEDHCFILLMKNPLEAKITPRTH

SEQ ID NO: 1147 - protein, 488 aa, Thalictrum flavum
MEVNLWLVSATFATLLAITTLIRMFKSSSQMKWPSGPKTLPIIGNMHQLGGDLLHVVLAKLAKVHGGVMTIWIGSWRPIIVVTDIDKVWEVLVSKSADYAARDFPEFTNFVTASRHTISSSDLGAFWQTLRKGLQNGALGPINIAAQSQFQERDMKQMTQAMVDEAGRNNNIVKPMEHIKKNSVRLLTRLIFGETFDDDEFVDSMLYDVDDVIRIGGFARLAEAFYYAKYLPGHRKAVREANLLKLRVEKLIRPFFSSNPPKNSYLYFLLSQNIPEEVIIFCIFELYCLGVDSTSSTTTWALAYLVHEQAVQEKLYQEIRMTLGDVDQVRIEDVSKMKYLQAVVKETMRMKPIAPFAIPHMTAKDTTLMGTKVAKGTSIMVNLYALHHNPDIWTEPYKFIPERFMQGEDGSATNKAMERSFLPFGAGMRTCAGMDLGKLQFAFVLANLVNAFKWSCVEEGKLPDLSEDLAFVLLMKTPLEAKITPRKS

SEQ ID NO: 1148 - protein, 492 aa, Xanthoriza simplicissima
MEMSPTLLVCATVAIVFTITTIIRNLFSSSSFSQMKWPTGPKKLPVIGNLHQLGDDVLHVALAKLAKVHGSVMTIWIGSWRPVIVISDIDKAWEVLVNKSADYGARDMPEITKIASASWHTISTSDAGPFWQNVRKGLQSGAMGPLNVAAQNQFQERDMKRLVNAMSDEALNSKGIVKPLDHIKKNTVRLLTRLIFGQTFDDDKFIESMHYEIEDIIRISGYARLAEAFYYAKYLPSHKKAEREAFLVKCRVEKLVRPLLSSNPPSNSYLYFLLSQNFEEEVIIFCIFELYLLGVDSTSSTTTWALAYLIREQGAQEKLYQDIRMTLGDVDLVKIEDVSKLKYLQGVIKETMRMKPIAPLAIPHKTAKETTLVGTKVAKGTRIMVNLYALHHNENIWPEPYKFMPERFLEGEAKTAYNKAMEQSFLPFSAGMRICAGMDLGKLQFAFALANLVNAFKWSCVEEGKFPDMGEELSFVLLMKTPLEARIAPRNV

SEQ ID NO: 1149 - protein, 354 aa, Berberis thunbergii
METGLVAPIPLSVQNVQDLSTKNLDVIPSRYIRPELANDIISIDEGSKIPIIDLSKLTDEQFCQDELERFHLACKDWGFFQLINHGVQQDALENVKREVTEFFKQPFEVKKEFSQQPGEVEGYGQAYVFSDEQKLDWGDMLYLITQPDVARNMKLWPTSPPTFRETIVKYSEELQKVKMCVMASMAKNLEIEPEKFTNMFEKGIQSMRFNYYPPCVEDDKVLGISPHSDATGITFLIQVNHVHGLQLRHKGNWVPVVLTTDAILVNIGDVLEILSNGKYKSIEHRVVINKTKERLSVAAFHEVNDNVMIGPLPELIKQGEDKYYKSLSFVDYTKLLNSEKLDGKTLIEQMKLKN

SEQ ID NO: 1150 - protein, 356 aa, Berberis thunbergii
MEVDEIRSYGASLPVENVQALAAKDLKEIPERYIRPELEFDVVVSIENSGEIPVIDLSRLLDEHFAHDELAKLHSACEEWGFFQLINHGASEEVIEKMKTDTQEFFRLPLEEKKAYTQVSNGIEGYGQAFVFSEEQKLDWGDMLFLFALPINQRNFKFWPTNPTSFRETTEKYSLEVHKVAICLLGLIAKNLGIEPEKFTKVFEDGMQHFRLNYYAPCPHAHKVLGLSPHSDGSALTLLTQVNDDVDGLQIKKNGNWMPVKPISGAFIVNIGDVIEITSNGKYKSIEHRAIIDPKKERLSIAAFHNQNFRTTIGPFPELVKGNSTEKYKTVSYQDYLRNITSTGLDGKNRLEFMKL

SEQ ID NO: 1151 - protein, 375 aa, Corydalis chelanthifolia
MEEVKEELSPKALVNSGSSLLVPSVKELAKEQLTEIPSRYIRFDQESPVTTFQPTCLPSVPVIDIHSLLFQESEAATASELNRLHSACKNWGFFQIINHGVSSSLIEKIKLEIKAFFELPMEEKQKLWQQPCDQEGFGQLFVVSEEQKLDWCDMFFIRTLPTTIRKPHLFEKLPVPLRETLENYSLEMKKLAKTVLEQMAKALKMDAEEMRLLFDDGFQEMRLNYYPLCSQPEKTIGFTPHSDASALTILLQLNETEGLQIRNEGKWVPVKPLPNAFVVNIGDVMEIVSNGIYHSIEHRAVVNSTMERLSIATFYRTNLEAEIGPARSLIGPHKPAVFKRVMTEKYYKDFFAREIKGKSYLDSMRINGTGEEKSS

SEQ ID NO: 1152 - protein, 370 aa, Corydalis chelanthifolia
  misc_feature (355)..(367): Xaa can be any naturally occurring amino acid
MAPAPISSINVGHIDDVQELRKIQPTKIPERYVRDIAERPTKTHARSPMQIPVIDLSKLMRNDKEMAQNELSKLAYSCENWGFFQVINHGIDTELIECIEEVAKKFFMLPLEEKQKFPMAPGTLQGYGHAFVFSEDQKLDWCNMLALGVEPFFIRNPKLWPTNPAEFSETLDLYSANIRKLCKILLTFIAMSLGLNDDMFNDMFGTAVQAVRMNYYPPCSRPDLVLGLSPHSDGSALTVLQQAKGSSVGLQIRKDDKWVPVKPVPNALVINIGDTIEVLTNGKYKSVEHRAVTNKEKDRLTIVTFYAPSYDIELGPLPECIDENRPCMYKKYNHGEYSKHYITSKLEGKKTLDFXXXXXXXXXXXXXTKI

SEQ ID NO: 1153 - protein, 379 aa, Corydalis chelanthifolia
  misc_feature (58)..(59): Xaa can be any naturally occurring amino acid
MEEIHLVSTVADDHISSIVNQRVQDFAINVKEPPSRYIRKAINDDIDFGLNQTTTVDXXKDDSLSSSSVPIIDLQRLSSSSIEEKKAEMEKLRSALASWGLFQAVGHGIPNTLLDEVRNISKQFFELPSEEKQKYSKLGGVDTFDDLEGYGNDPVTSGDQVLNWNDRLYLLVKPEEQRKLNFWPEHPNHFRDTLHEYSVKSSIAAEFILKTMSELLGLKEKYLLNQLGEQAPVYVRFNYYPPCPRPDLVYGMTPHSDVGGITIILQDEVEGLQVLKDEKWINVPTIPHALLVNMADLMEMMSNGQFKSPVHRVITNAEKERISLAMFFSPELDKEIQPAAELIDDDKPRLFKKVIVKEYFKYFFPRYLEGKRAIDWAKV

SEQ ID NO: 1154 - protein, 351 aa, Corydalis chelanthifolia
MEVKTLAESRLPHVPPQYIQPVENRPAIDSCREKSSDFGIPVIDLFNFDPQCSSGACQELGRACRDWGAFQIINHGVPKRLLDEMMTAGLSFFNECSSAEKRKYSCDPNSAASEGYGSRMLVKEDTVLDWRDYFDHHTLPLSRRNPNRWPQSPSSYRGVVVEYSDHIKSLAVKLMSMISESLGLPGSCIEDIVGEIYQNITISYITISYYPPCPQPELTLGLQAHSDIGAITLLIQDDVGGLEVLKGEEWVTVQPLSGAIVVILADQTEIITNGKYRSSVHRAVTNSHRARLSVGTFHDPSKSRKICPATGLISKDSPAKYREVVYGDYISAWYSKGPEGKRNIDALLIHE

SEQ ID NO: 1155 - protein, 362 aa, Corydalis chelanthifolia
MKNEMIIEKGLGGSLPVESVQALASKDLKDIPARYIRPELESDVVNTDGSLEIPVIDLSRLLDQQFMYEELKKFHSACEDWGFFQLINHGVPEEVVDKMKVDVEEFFKLPLEEKKPYSQLPGVLEGYGQAFVVSEEQKLDWGDMLFLHAQPVVGRNMTLWPKHPTSFRATLDKYSSELQRVTVCLIECMAKNLGFVDPEKLTSMFEIGWEGVRMNYYPPCVVNADKVLGISPHSDATGLTLLIQVNEVQGLQIRKNGNWVPVKPIPGAFIVNIGDMIEIMSNGKYKSIEHRAVIDPLKERMSIAAFHSPEPKTIGPLPEMVKMSGGVEKYKTLNYVEYLKLLYSSKLDGKNLLEFMKLDQGM

SEQ ID NO: 1156 - protein, 372 aa, Corydalis chelanthifolia
MEEEKEELSPKALVNFGSSLLVPSVKELAKKQLTEIPSRYIRFDQESPVTTFQPTCLPSVPVIDIHSLLFQESEAATASELNRLHSACKNWGFFQIINHGVSSSLIEKIKLEIKAFFELPMEEKQKLWQQPCDQEGFGQLFVVSEEQKLDWCDMFFIRTLPTTIRKPHLFEKLPVPLRETLENYSLEMQKLAKTVLEQMAKALKMDAEEMRQLFDDGFQAMRLNYYPLCSQPDKVLGFTPHSDSCALTILLQLNETEGLQIRNEGKWIPVKPLPNAFVVNIGDIMEIVSNGVYRSIQHRAVVNSMKERLSFVTFYSTNIDAEIGPACSLIEPHKPALFKRVMTEKYYKDFFAREIKGKSYLDSMRINVSGES

SEQ ID NO: 1157 - protein, 347 aa, Corydalis chelanthifolia
MGFVKNLSESTILTSIPSDYDFSTINSDYSPSVTTEEESIPIIDFSLLTSSSPQQRSQIVQDLGNACLQWGFFMVVNHGIPERLKEEVFQSCQDFFDLSEDEKLGYTAGKHVLDPIRCGTSFNASVEKVFFWRDFLKVFVHPEFHSPKKPIGFSGISNEYSKRVREIARELLKGISESLGLEASYIEKAMELQSGLQIFVANLYPPCPQPELAMGMPPHSDHGLLTLLMQNDVGGLQVKHKGKWVHVNPLPNSILINTGDHLEILSNGKYKSVLHRATVNNNTTRISIAVAHGPSLDTLVTPAPGLVISEIHPPRYHGMKYKEYLELQQSNQLDGKSCLDRVRVLNV

SEQ ID NO: 1158 - protein, 361 aa, Cissampelos mucronata
MTTWVPSLPVPNVQDLAAKKLEEVPDRYIQREAESENVAIELSDQVPVIDLQRLLHHDPSIASDEMAKFHMACKDWGFFQLINHGMDEELMRKMVNNLEEFFNLPLEEKKAYAQTPESFEGYGQAFVASKEQKLDWSDMLGLQTLPVNRRAMRVWPKKPLSFSETIDKYAFGMQKVTFCLLSLIAKNLGVEPQKLTSIFEDGIQGTRMNYYSPCPQSDKVLGLSPHSDANLITLLIQNNDLPGLQIKIDGKWIPIKPISGAFIVNIGDSIEILSNGLYKSIEHRAVIHADRARISIAGFQAPRSGVVIEPLPELLEKENVVANYKSVDYEEYLRQYFSAKLNGKSMLDLIKLKIHKDEERA

SEQ ID NO: 1159 - protein, 349 aa, Cissampelos mucronata
MESLSIDASSVLDLVSKNPETIPSRYIRPENDHQIVVTSIHNEVPVIDLSKLIFDANNGGVSDEEMKNLHLACQEWGFFQLVNHGVDEEAMKKIVEDVREFFELPLKLKKECSSEMEGYGQAFVLSEEQKLDWGDMFFLFTGPDSIKNYEVWPAHRPFTFRETINKYSSEMEKIKIILVGLMAKNLGIDQDKFINLFKDGVQSMRMNYYPPCPDPSKVLGISPHSDATGITILLQLNEVDGLQIRHGGNWVPVKMLPGALLVNIGDIIEILSNGIYNSIEHRVVINKEKERMSVATFHETHNSVDIGPLPELVINGETKYKSVAWDEFSELFLSQKLDGKSLLDALKLN

SEQ ID NO: 1160 - protein, 388 aa, Cissampelos mucronata
MLREKMTIEAKEKLISIHSISEEDQLISMDHQVPLTLGSSLLVPSVQEMARKSALDAIPKRYIRDDLRQELMNVTRSDETDRLLPSLPVIDMKALLDERDVELEKLHSACKDWGFFQLVNHNVDENLVEKVKGVIQDLFNHPIEEKQKYWQKPGDLEGFGQAFVVSDEQKLDWADMFYMVTQPEHSRKPHLFPLLPHPIRETFEEYSIELKNLALKVLKMMAKALKMDVEEMNSLFAEGKQAFRINYYPPCPQPEKVIGLTPHSDAVGLTILLQVNDVEGLQIRKDGMWVPVKPLPNGFIVNVGDILEMVTNGNYRSIEHRAVVNSSKERLSIATFYSPGVDAEIGPAPSLINSNSPPIFKRINGEDYFKGLFARELAGKSYLDCMRI

SEQ ID NO: 1161 - protein, 355 aa, Cissampelos mucronata
MATEQEEYFPSLPVPNVQDLSSNLANDIPDRYIRPEFQSEFVCDDKSFAIPVIDFSRILDEKFRDHEMTKLHAACQEWGFFQLINHGSEEAIEEIKSHVEEFFKQPLAAKKAYTQERNSIEGYGQAFVQSEDQKLDWGDMFLVRAFPVRKRNMRFWPNYPSTFRGTLDRYSSEVRKLAIGLLGLMAENLGLDAEKLTGMFGDLQQSLRMNYYPPCPQADKVVGISPHSDPLPLTLLIEANNVQGLQIRKNSIWVPVHAIPGAFIINIGDMLEIWSNGKYKSIEHRVVVNPYRERLSVAAFHAPNEDSIVGPLQDLVNKEGAKYKSIDANSYYKLKNTIQGKMHANEMKLVTPTTN

SEQ ID NO: 1162 - protein, 373 aa, Chelidonium majus
MSCSCPQVDWPEPIVRVQSISDSGSPVIPDRYIKPPLERPSKLGLARTSITSTNDQDVLNIPLIDLGGLLIQDEDNLILPDSILNQICMACQNWGFFQIVNHGVSPDLLHRVREVWREFFHLPYEHKQVYANSPKTYEGYGSRLGVEKGAILDWSDYFYLHYLPQCLKDPNKWPALPTSCREVVDEYCCQLVKLSKNLLKILSITLGLGESYLENAFGGEEIGACMRVNFYPKCPQPDLTLGLSSHSDPGGMTLLLPDNQVVGLQVRKDDNWVTVKPAPNAFIVNIGDQVQVLSNAIYKSVEHRVVVNSVEERVSLAFFFNPRGDLPLQPAKELVTSDRPALYLPMTFNEYRLYIRTQGPRGKVYMESLKSPR

SEQ ID NO: 1163 - protein, 362 aa, Chelidonium majus
METPKPVTLGGSLPVPSVQELAKQPLLQVPPRYIRSDQDLPIISESDDVSATFQTVPVIDLKSLLCGDTELERLHSACREWGFFQLVNHGVNTSLVEKVKSEIQDFFKLPMEEKKKYWQKEGDVEGFGQDFVISEEQKLDWADIFFMITLPRHARKSHLFPELPLPLRETLESYSSEMKNLAMSLFEVMSKALDVETQLVTELFEDGMQNMRMNYYPPCPQPELVVGLTPHSDAVGLTILLQLNEMEGLQIKREEKWVPIKPLPNAFIVNIGDILEIVTNGIYNSVEHRAIVNSKKERLSIATFHSIKLGGEIGPIPCLVTPKTPALFRTVGVAEYYKHRYSRTLHGKSYLDFMRIEGNHDS

SEQ ID NO: 1164 - protein, 365 aa, Chelidonium majus
MAPVPISSIRVGQIDDVQELRKSRPKSIPERYVRDIAERPRLAKLQPSLPMQIPVIDLSMLDETNTYQSQKELSKLAASCRDWGFFQVINHGIDTDLLKTIEKVATEFFMLPLAEKQKYPMLPGTVQGYGHAFVFSEDQKLDWCNMLALGVEPFFIRNPKLWPTNPAKFSETLETYSTNIRKLCKNLLRFIAMTLGLNQDTFNKMFGEAVQAVRMNYYPPCPRPDLVLGLSPHSDGSALTVLQQGTGSSVGLQILKDDKWVPVQPLHNALIINIGDTIEVLSNGIYKSVEHRAVTHKKKDRLSIVTFYAPSYEIEIGPLPELIGQNQPCMYRRFNHGEYSKHYINNKLEGKKTLDFAKIQTKLSS

SEQ ID NO: 1165 - protein, 372 aa, Chelidonium majus
MTMEPTILETKTEEKSISESTTYQKGVKHLCECGVSKVPNKYIFPVSERKGEEPKNSGSNLKLPVIDFDQLKGSNRCQVLNSLSKACEDFGFFQVINHGIPDDIIQNMIETSRGFFELPLEERSKYMSTDVRAPVRYGTSFNQINDSVYCWRDFLKLACHSLPDSVPHWPSSPADLRDAASTYAEENKSLFKMIMEAILESLGLIRTTETDDDNDVLKEFEDGSHLTVINCYPSCPQPELTLGMPPHSDYGFLTLLLQDEVEGLQIQHKGEWVTVEPIPNAFVINIGDHLEIFSNGRYKSVLHRAIVNSTKCRTSIASLHSMPMMNMVKPSPKLINEENPRRYKDTNFATFIDFIASNDLKEKSFLDSRKLT

SEQ ID NO: 1166 - protein, 374 aa, Chelidonium majus
MTPLMETPPKVISLGSSLPVPSVQELVKQPLERVPPRYVQQQDQDSSRLVISSDDSCLVLPTVPVIDLQNLLSPESIIGDLELEKLDSACKEWGFFQVVNHGITNTLVEKVKLEVQDFFKLPVEEKQKYEQIRGEIEGFGQAFVISKDQKLDWADLFFMVTHPLHLRKPHLFPKLPLPLRDTLESYTTELRNLTMTLLESMAKALRLETKEMTDLFEDGRQSMRINYYPPCPQPELVIGIRPHSDATGLTILLQLNETEGLQIRKEGIWIPIKPLPNAFIVNIGDMLEIVTNGVYRSVEHQVTVNKMKERLSIATLYSPGLEREISPLPSLITPQTPTLFKKIEVEKYLKELFNRELNGKSFLDVMRTEGGGKE

SEQ ID NO: 1167 - protein, 356 aa, Chelidonium majus
MEFSLSGGTSVGVQTLAESGLDHVPSRYIQPPENRPVTSFSCRKTSDSGIPVIDLFNFEPKRSDDVLQELRRACRDWGAFQVRNHGVPKRLLEDMIKVGLSFFKESSVEEKCKYSCDPNSAASEGYGSRMLVKEDTVLDWRDYFDHHTFPLSRRNPNRWSESPSNYRGVVEEYSDHIKVLALKLMSMISESLGLQSSCIEDIVGEVYQNITISYYPPCPQPELTLGLQAHSDIGAVTLLIQDDVGGLQVLKDDEWVTVQPLSDAIVVILADQTEIMTNGQYKSSQHRAITNSHRARLSVGTFHDPSKTRKIAPAAPLIRKDSPAKYKEVIYGDYVSSWYTKGPEGKRNIDALLLHQ

SEQ ID NO: 1168 - protein, 372 aa, Chelidonium majus
METPPKQQVTLGVSLPVPSVQELAKQPLSQVPPRYVRSDQDPPIIYESHHDVSSSTTTVQNVPIIDLKSLLSQGPIGDSELERLHFACREWGFFQLVNHEVNTSLVEKVKTEIQDFFKLPLEEKKKYWQKEGDVEGFGQAFVISEEQKLDWADLFFMITLPRDARKSHLFPELPLPLRETLESYSSEMKNLAMTILEVMSKALHIETKLMTDLFEDGMQNMRMNYYPPCPQPELVIGLTPHSDSVGLTILLQLNEMEGLQIKREGKWVPIKPLPNAFIVNIGDILEIVTNGIYNSVEHRAIVNSKKERLSIATFHSIKLGGEIGPIPCLVTPKTPALFRTVGVAEYYKHRYSRTLHGKSYLDFMRIEGNNDS

SEQ ID NO: 1169 - protein, 364 aa, Chelidonium majus
MEGSHLPAEETSSLEKRVQELAINCKEPPPRYICKTDNEEENQRPADDHLSYSVPIIDLSRFSSRSSITEKEEEMEKLRSALNSWGLFQAIGHGIPKNLLDDVHNVTKQFFELPIEEKQKYTKADSEIVDLQGYGCDRIVSEDQVLDWSDRLYLLVDPEEQRKLKLWPEPPSNFRNTLHEYSAKSSSVAELILKVMAESVGLEENNFLSQIGEQVLTYARFNYYPPCSRPDRVYGIKAHADGGALTILLQDKEVEGLQVLKDDRWINVPSIPYALLVNVADLMEIMSNGLFKSPVHRVVTNTERERISLAMFYSPAFDKEVEPAAGLIDESKPRMFRKVNVKNYLEVFFPRYLQGKRAIDWAKV

SEQ ID NO: 1170 - protein, 364 aa, Chelidonium majus
METPKPVTLGVSLPVPSVQELAKQPLSQVPPRYVRSDQDPPIIYESHHDVSSSTTTVQNVPIIDLKSLLSQGPIGDSELERLHFACREWGFFQLVNHEVNTSLVEKVKTEIQDFFKLPLEEKKKYWQKEGDVEGFGQAFVISEEQKLDWADLFFMITLPRDARKSHLFPELPLSLRDTLESYSSEVKNLAMTILEVMSRALHIETKLMTDLFEDGMQTMRMNYYPPCPQPELVIGLTPHSDSVGLTILLQLNEMEGLQIKKEGKWLPVKPLSNAFIVNIGDILEILTNGIYNSVEHRAVVNSMKERLSIATFHNVKLDGAVGPIPCLVTPETPALFKTVGAAEYFKHLFSRKLHGKSYLDSMRI

SEQ ID NO: 1171 - protein, 390 aa, Chelidonium majus
MTAKLQRDSREREREERVRKEASMDQTTKSVRIGTCLLVPSVQELAKQHFVKVPPQYICPNQDPAPIFSQTLETHSLFVPTVPIIDLQRLLSQEPHGDLELGRLDSACKDWGFFQLVNHGINSSLIEQVKSEVQDFFRLPMEEKKKFWQNEGDIEGFGQKFVVSKEQKLDWSDMFFMITLPLHSRKPHLLPKLPLPLRVTIESYSEELKRLTMTLVELIAKSLQIEPKLMTELFEDGRQAMRMNYYPPCPQPELVMGIPPHSDSVGLTILLELNEIEGLQIKKEGMWVPIKPIPGALLVNIGDMLEIVTNGIYQSVEHRATVNSLKERLSLATFYSPGLEREISPAPSLITPQTPALFKSIGVGNYLTKTRFNKDQLHGKLLHSLRNVTG

SEQ ID NO: 1172 - protein, 359 aa, Cocculus trilobus
MKVGSLPVPNVQDLASKKLKEVPDRYIQREPESEHVSFEMSDQVPVIDLERLLDDEPFIYSDEMAKFHLACKDWGFFQLINHGVDEELLKKMVSNVEEFFKLPLEEKKAYAQLPDDLEGYGQAFVVSEEQKLEWSDILLLRTLPVSIRNLRFWPEKPSSFSETLDKYAFAMEKVTFLLLNLIAKNLGVEPKMVTSIFEDGIQGVSSNYYPPCPAPEKVLGISPHSDASMITLLIQNNELPGLQIRKNGNWVPIKPIPGAFVVNIGDAIEIMSNGLYKSIEHRAVIHPDKERISIAGFQDPRSGVLVGPLPELLKKKNVGANYKTVNFDEYLRQYISAKLDGKTMLDLVKLEKPEIQEGA

SEQ ID NO: 1173 - protein, 359 aa, Cocculus trilobus
MDQKAQVTVTLGSSLLVPNVQEMARKALNTIPERYIRDDLEPHFVTISDPTLLPSVPIIDMKALLEGELVDSELEELHSACKDWGFFQLVNHSVSGSLVEKVKVGIQEFFNLPIEEKQKYWQKPGEVEGFGQAFVVSEEQKLDWGDLFFVLTQPAYLRKPHLFPLLPQPFRGILEEYSIELKNLANKVLEMMAKALKMEDEEMKLLFEDGMQSMRMNYYPPCPQPEQVIGLTPHSDAVGLTILLQVNEMEGLQIRKDGMWVPVKPLPNAFIVNVGDVLEIVTNGIYRSIEHRAVVNSSKERLSVATFYNPRIDGEMGPAPSLIKSDSLALFRRISVQDYFKGLFARELVGKSYLDSMRI

SEQ ID NO: 1174 - protein, 364 aa, Eschscholzia californica
MEITQKEIKLGKSLLVPSVQEMVKQPIAEIPPRYLQPDQNTPNTSSDVSLPQLSVPIIDLESLLTPGSVGDLELDRLDSACKEWGFFQLINHGVSSSLVEKVQLETQDLFRLPMIEKKKYWQTEEEVEGFGQAFVVSEEQKLDWADIFYLTTLPIHGRKPHLFPKLPLPFRDTLDSYSLELKSLAMTLIKVMAKALQIETKVIEELFEDGLQSMRMNYYPPCPQPDLVIGLKSHSDSVALTILLQLNEVEGLQVIKDGKWVPIKPLSNAFIVNIGDILEILTNGIYRSVHHRAIVNSTKERLSIATFLNPNPEGEISPIGSLITPSTPALFKTVGVKQYLQDLFTRELDGKSYLDCMKIDGNTT

SEQ ID NO: 1175 - protein, 362 aa, Eschscholzia californica
MDISQKEVKFRSLLVPSVQEMVEEPIGEIPSRYLQPGQNTPIITTDVSLSVPIIDLESLLTPGSIGDLELEKLDSACKEWGFFHLINHGVSSSMVERVQLETQHFFRLPVVEKKKYWQSEEEVEGFGQTFVVSEEQKLDWADVFYLTTLPVHARKPHLFPKLPLPFRDTLESYSLELKSLAMTLLRVMAKALQVETKELEELFDEDGFQSMRMNYYPPCPRPDLVVGLRPHSDSTALTILLHVNEVEGLQVIKDGKWVPIKPLPNAFLVNIGDVLEILTNGIYRSVEHRATVNSTKERLSTATFLNPKLEGEISPIKSLITPNNPALFKTIGVKQFYQDLVMRELNGKSHLDFMKIESNNTA

SEQ ID NO: 1176 - protein, 368 aa, Glaucium flavum
METAKKPIIIGGSLLVPSVQELAKQPLVQVPTRYVRSDQDSPTLSDDISTIPTVPVIDLQCLLSPEAIGDSELEKLHSACQEWGFFQLVNHGVSPSLVEKVKMEIKDFFRLPMEEKNKYWQEERQVEGFGQAFVVSKEQKLDWADLFFMVTLPLHARKPHLFPKLPLPLRETLEFYSSELKILTMTLLKMMCKALQIGTKEMTELFEDGMQSMRMNYYPPCPQPELVIGLTPHSDSTGLTILLQLNEMEGLQIRKDGTWVPVKPLPNAFIVNIGDALEIVTNGIYRSVEHRAMVNSMKERLSVGTFHGPRLEDEIGPLPNLINPDRPAMFRRVRVEEYFKKLFTRALDGKSFIDSMRIEMGCAEAKPA

SEQ ID NO: 1177 - protein, 368 aa, Glaucium flavum
METAKKPIIIGGSLLVPSVQELAKQPLVQVPTRYVRSDQDSPTLSDDISTIPTVPVIDLQCLLSPEAIGDSELEKLHSACQEWGFFQLVNHGVSPSLVEKVKMEIKDFFRLPMEEKNKYWQEERQVEGFGQAFVVSKEQKLDWADLFFMVTLPLHARKPHLFPKLPLPLRETLEFYSSELKILTMTLLKMMCKALQIGTKEMTELFEDGMQSMRMNYYPPCPQPELVIGLTPHSDSSGLTILLQLNEMEGLQIRKDGRWVPVKPLPNAFIVNIGDILEIVTNGIYRSVEHRATVNSMKERLSIATFHSPGLEDEIGPIANLITPDRPAMFRSVRAEEYFKKRFTRALDGKSFIDSMRIEAGCGEGKPT

SEQ ID NO: 1178 - protein, 368 aa, Glaucium flavum
METTKMPSSYVPVPSVQELATQIDDLVQIPARYVRSDQESSTIFSDEISTNIPSVPVIDMQCLLSLETINGVSDELDKLHFACQEWGFFQLVNHGVSTALVEKVKSEIQDFFKLPMEEKKKYSQKDGGVEGFGQVCVVSEEQKLDWADIFFMFTLPLHARHLFPELPLPLRETLESYSSELKSITMTLLRMMAKALQIETKDMTKLLEDGVQSMRMNYYLPCPRPELVIGLTPHSDATGLTILLQLNEMEGLEIRKDGRWIPIKPLPNAFIVNIGDILEIGTNGIYRSVEHRATVNSTKERLSIATFHNPSLQDEICPLPNLITSDRPAMFRSIMTEEYNTKLLTRALDGKSLLDSLRIEAKCEDDGN

SEQ ID NO: 1179 - protein, 358 aa, Glaucium flavum
METAKKPIIIGGSLLVPSVQELAKQPLVQVPTRYVRSDQDSPTLSDDISTIPTVPVIDLQCLLSPEAIGDSELEKLHSACQEWGFFQLVNHGVSPSLVEKVKMEIKDFFRLPMEEKNKYWQEERQVEGFGQAFVVSKEQKLDWADLFFMVTLPLHARKPHLFPKLPLPLRETLEFYSSELKILTMTLLKMMCKALQIGTKEMTELFEDGMQSMRMNYYPPCPQPELVIGLTPHSDSTGLTILLQLNEMEGLQIRKDGTWVPVKPLPNAFIVNIGDMLEIATNGIYRSVEHRATVNSLKERISIATFHNPNPEDEICPLSNLITSDRPAMFESIRAEDYTKKLLTRALDGKSLLDSLED

SEQ ID NO: 1180 - protein, 362 aa, Hydrastis canadensis
MEEPKLSYGSSILVPSVQELAKQALASPPPRYIKPHQDPPIISYSSLIPPIPVIDMQKLLYGEDMDSELETLHSASKEWGFFQLVNHDVNTILVEKVKHEIQEFFQLPLEEKKAYWQKEGEVEGFGQAFVVSNEQKLDWGDMFFMLTLPIYARKPHLLPQLPLPFRDTMDTYSLESKNLAMKILEIMEKALKMEVNEMTNLFEDGMQSMRMNYYPPCPQPELVIGLTPHSDTAALTILLQVNEVEGLQIRKEGMWIPIKPLPNAFIVNIGDMLEIITNGIYRSIEHQATVNSEKERLSIATFYSPRHNVEMGPAQSLVTPQTPALFRRIGVEEYSKGLFSRVLDGKSYLDVMRTENGKNNSN

SEQ ID NO: 1181 - protein, 362 aa, Hydrastis canadensis
MEEPKLSYGSSILVPSVQELAKQALASPPPRYIKPHQDPPIISYSSLIPPIPVIDMQKLLYGEDMDSELETLHSASKEWGFFQLVNHDVDTILVEKVKHEIQEFFQLPLDEKKFFWQREGELEGFGQAFVVSDEQKLDWGDMFFMFTLPIYARKPHLFPQLPLPFRDTMDTYSLELKNLAMKIIGMMEKALKMEVNEMTNLFEDGTQSMRMNYYPPCPQPELVIGLTPHSDSVGLTILLQVNEMEGLQIRKEGMWIPIKPLPNAFIVNIGDILEMVTNGKYCSIEHQATVNSVKERLSIATFYSPRHNVEIGPAQSLVTPQTPALFKRIGMEGYLKGLFTRQLDGKSYLDVMRIENGKNNSN

SEQ ID NO: 1182 - protein, 362 aa, Hydrastis canadensis
MEEPKLSYGSSILVPSVQELAKQALASPPPRYIKPHQDPPIVSNSTLIPTIPVIDMQKLLYGEDMDSELETLHSASKEWGFFQLVNHDVDTLLVEKVRHEIQEFFQLPLDEKKFFWQREGELEGFGQAFVVSNEQKLDWGDIFFMLTLPIYARKPHLFPQLPLPFRDTMDAYSLESKNLAMKILEIMEKALKMEVNEMTNLFEDGTQSMRMNYYPPCPQPELVIGLTPHSDTAALTILLQVNEVEGLQIRKEGMWIPIKPLPNAFIVNIGDMLEIITNGIYRSIEHQATVNSEKERLSIATFYSPRHNVEMGPAQSLVTPQTPALFRRIGVEEYSKGLFSRVLDGKSYLDVMRTENGKNNSN

SEQ ID NO: 1183 - protein, 356 aa, Jeffersonia diphylla
METEMINTWEFGGSLPVENVQALAAKELKDIPDRYIRPELQSDHVSIDESREIPVIDLSRLLDEQVSLDELAKFHSACEGWGFFQLINHGVSEEIINKMKIDVQDFFSLPLEEKKACSQVATSIQGYGQAFVVSDEQKLDWADMLFILPLPVRERNMRFWPNTPTSFRETLDKYSLELQRVTVSLIGLMARNLAVEPEKLTNMFENGLQGVRINYYPPCPQADKVLGLSPHSDAVALTLLIQVNDVEGLQIRKRGNWVPVKPIPGAFIVNIGDIMEIISNGKYKSIEHRAIINPKKERLSIAAFHSPNLSTLIGPLADLVNESGEHYKTIMFEDYLKHIVSSKLDGKSTLDYLKLD

SEQ ID NO: 1184 - protein, 351 aa, Jeffersonia diphylla
MGTEVPMPMSVENVQDLATKILDVIPSRYIRPELMTDVVSIDEESMIPIIDLSKLTDDHVSQAELEEFHLACQNWGFFQLINHGLKEDVLEKLKMDVTEFFNLPIEAKKEFSQEPGQMEGYGQAFVFSDEQKLDWGDMLYLVTQPEAARRMKLFPTCPSTFRDTIANYSLESERVKMCVLGVMAKNLGIEREKFTNTFEGGIQSMRFNYYPPCLEEDKVLGISPHSDATGITLLVQVNQVHGLQIRHEGRWVPVVLATDAILVNIGDVLEILTNGKYKSIEHRVVINKNKERLSVAAFHEVNENATVGPIPELVKDGEECYQSFSFDEYAELLIGEKLDGKSLIERMRLKK

SEQ ID NO: 1185 - protein, 362 aa, Mahonia aquifolium
MAPTPISPLQVGHIIDVQELRKVRTKTIPRRYIRAVAERPISAATSTMHIPVIDLSKLIEGNSDQSQMELSKLASACEQWGFFQVINHGIDISMMENMEKVGKEFFMLPVEEKQKYPMAPGTIQGYGQAFVFSEDQKLDWCNMLALGIEPHFIRNPKLWPTNPANFSETLETYSEEVRKLCQNLLRFIATSLSLRDETFNDMFGVPVQAVRMNYYPPCQRPDLVLGLSPHSDGSALTVLQQAAGSSVGLQILKDDKWVPVQPVPNALVVNIGDTLEVLTNGKYKSVEHRAVTHKDKDRLTIVTFYAPDYEIELGPLPEFVSENRPCMYRKYNHGEYSRHYVTNKLQGKKTLDFARIQTEFSA

SEQ ID NO: 1186 - protein, 354 aa, Mahonia aquifolium
MEVGLAETLQYNVQLLASKKLDVIPSRYIRPELAADIICMDKASVIPVIDFSKLCDDTFSQDELEKFHLACQDWGFFQLVNHEVPKEVLEKVKTDLTEFFNLPIEEKMACQQPGQEEGYGLVVMFSDEQKLDWGDMIGIVTQPETTRNVNVWPNSPLTFRETIAQYSLELQKIKTCILGLMAKNLGIEPEKFTNMFEGGMQSMRINYYPPCQKDDKVLGLSPHSDSNGITFLIQVNDVQGLQIRHEGCWVPVVLSTDAILVNIGDVLEILTNGRYKSVEHRVVINKNKERLSVAAFHELNENETIEPLQELIKEGEDKCYRSLSFAEYQKLESSHYLSHYLDGKTLIEKMKLKK

SEQ ID NO: 1187 - protein, 353 aa, Menispermum canadense
MSSNTGHFGGSLPVENVQALASQELKEVPSRYVRPELAFDVVSIDESLQIPVIDLFRLTDQRYARDELAKLHSACEDWGFFQLINPGVPHDMIENMKADTEEFFKLPLEVKKAYSQLPNSIEGYGQAFVVSEEQKLDWGDMLFFFCQPLNERNMRIWPNHPDSFRETLDKYSAELQRVALCLLGFLAKNLGLDPEKFINMFENGMQGVRMNYYPPSPQAEKVLGISPHSDADSLTLLLQVNEVQGLQIRHNGIWVPIEPIPGALIVNIGDVIEIMSNGKYKSIEHRSIVNTKKERLSIAAFHTTKAGTTIGPISDLVKENGANYRTVSDEDFLRQVITNKLDGKSVLDHMKLK

SEQ ID NO: 1188 - protein, 356 aa, Menispermum canadense
MSSLETMRESTVPLAVENVQVLASKNLKEIPLRYIRPEHELEISSINEITEASSSDVPVINLSRLTDDDEQFYQEEMGKFHFACQEWGFFQLVNQGVAEDVMEKMIRDVSEFFKLPFEEKKACSQDADQMEGYGQSFVFSEEQKLDWGDMLFLFTQPLLSRNFKESVSRYSSEMERIKTILVGQMGKNLGINQEEFTNMFNNGVQSMRFNYYPPCPQASKVLGVSPHSDATGLTVLLQLNQVQGLQIRHDGQWVPVNILPDALLVNIGDILEILSNGRYKSIEHRVVINKEKERMSVAVFHETNKSAETGPLPELLLNNEGETDKYRSVSFEGFVNLFSSRKLDGKSLVDFMKLKK

SEQ ID NO: 1189 - protein, 368 aa, Menispermum canadense
MADEKAKEAVPVTLGSSLLVPSVQEMARKAISTVPERYVRNDLDPPFSTNPTLLPTLPTIDMNSLLDGESADSELEKLHLACKDWGFFQLLNHGVSASLVEKVRIGIQDFFNMTIEEKQKFWQKPGEVEGFGQAFVVSEEQKLDWGDLFFCTTQPAYQRKPHLFPMLPQPFRETLEEYSLELKNLAMTLIEMMAKALKMDIEDMKLLFEDGMQAMRMNYYPPCPQPDQVIGLTPHSDAVGLTILLQVNEMEGLQISKDGMWVPVKPLPNAFIVNIGDILEIVTNGIYRSIEHRATVNASKERLSIATFYNPKFDGEMGPAPSLIKKDSPPFFIRMRVEEYFKGLFARELVGKSYLDSMRIRYEKSGIV

SEQ ID NO: 1190 - protein, 356 aa, Menispermum canadense
MTVGPLTVPNVQDLASNKLKDIPHRYIQREPESEHVLFEISDEVPLIDLQKILHESFSSDEMAKLHMACKDWGFFQIINHGVDEELIKRMLNDVEEFFKLPLEEKKAYAQLPNSFQGYGQELVVSQEQKLDWSDMLVLHTLPISRRNMKFWPINPASFRETLDKYTMETERVTLCLLSLMAKNLGVEAEKVTSIFEDGIQAVRMNYYPPCSQADKVLGISPHSDASIITLLIQNNQVPGLQIRKDGNWVPIKPIPSAFIVNVGDVIEIMSNGLYRSVEHRAVIDPEKERISIAGFQDPRNGVLVGPLPELMEGNKGANYKTVSYDEYLRQYLSAKLNGKSVLDLLKLEKCEIKERV

SEQ ID NO: 1191 - protein, 359 aa, Nandina domestica
MGSEQMNDEQRVFGGSLPVDYVQVLAAKKLKEIPDRYIRSELEFEVVSIDLSNKIPVIDLGKLLDEQFRRDEMAKLHSACEDWGFFQLINHGVSEEIIQKMKTNSHEFFNLPLEEKKVYANLPSSNEGYGQAFVVSEEQKLDWVDMFFVTTLPLHERITRLWPNNPTSFRETLDQYSLELQRVTISLAGFMANNLGVEPEKLTNMLENGSQGITMNYYPPCPHADKVIGLSPHSDACAITLLIQVNEVEGLQIRKNGNWVPIKPIAGAFIVNIGDTMEILSNGKYKSNVHRAIVHPQKERISVAAFHRPNLSAMIDPLSELVKESGKHYKTILFQDYLKHYFASKLDCKSALDLIKLDN

SEQ ID NO: 1192 - protein, 371 aa, Nandina domestica
  misc_feature (329)..(329): Xaa can be any naturally occurring amino acid
MESKQVYKSRMLGGSLPVENVQALASKKLQEIPDRYIRPELEFDVVSVNLSNEVPVIDLRKLLDEQFGCNEMAKLHSACEDWGFFQLINHEVSEEIIEKMKIDLQGFFSLPLEEKKAYGQLANSNEGYGQAFVISEEQKLDWADRLYIVTLPVEERNMRFWPNTPTSFRETLDKYSVELQRVAVCLVGLLASNLGVEPKNLTNMFDKGFQAVRMSYYPPCPCADKVIGLSPHSDAVALTLLIQVNEVEGLQIRKNGNWVPIEPIPGAFIVNIGDAMEIISNGKYKSIEHRAVIHPQKERISVAAFHGPNLNAMIGPLSNLGKESGEHYXEVGGGQNMGKTVAIVVGGVAAVGFALICLMFLRSLMKKHDDY

SEQ ID NO: 1193 - protein, 372 aa, Nandina domestica
MAPAAIPSLKVGHIHDVQELRKARRRTIPKRYVRDIAERPITSVTSTMHIPVIDLSKLIQGDIDQSQTELLKLASACKDWGFLQVINHGIDVSLLESIEKVTKEFFMLPLAEKQKYPMAPGTVQGYGQAFVFSEDQKLDWCNMLALGIEPHFIRNPKLWPTKPAEFSETLEMYSTEIRKLCKNLLRFIAMSLGLKDDVFNGMFGTPVQAVRMNYYPPCPRPDLVLGLSPHSDGSALTVLQQAAGSSVGLQIYKDDTWVPVQPVPNALVINIGDTLEVLTNGIYKSVEHRAVTHRDKDRLTLVTFYAPSYEMELGPLPEFIDENRPCMYRKYNHGEYSRHYVTNKLEGKKTLDFAKIQTKCRLKSPPRFNLTL

SEQ ID NO: 1194 - protein, 353 aa, Nandina domestica
MESANELGGSIPVENVQALAAKDLKEIPHRYIRPELESDVVSIDKSREIPVIDLGKLLDEQFAPEELAKLHSACADWGFFQLINHGASEEIIEKMKHDIQEFFRQSLEVKNAFSQLPNSVEGYGQAFVVSEEQKLDWADMLYLETLPISQRKVNLWPTTPTSFRETLDKYSLELQRLTICLIGLIAKNMEIEPQKMTNIFENGTQGVRMNYYPPCPCANQVLGLSPHSDGSGLTLLIQVNEVAGLQIRKNRDWVPVKPIAGAFIVNIGDAVEIFSNGKYKSIEHRAVINPEKERLSIAAFHDPNLSTMIGPLPELVKENGERYKTIKYKDYIKQVMASKLDGKSSLDSLKLQK

SEQ ID NO: 1195 - protein, 357 aa, Nandina domestica
MESEMNKAIEVGGSIPVDNVQALATTELKEIPHRYIRPEFESDVVSNDKSGKIPVIDLCKLLDEQFSHDELAKLHSACEDWGFFQLINHGAAEEIIEKMKIDIQEFFRQPLEVKKAYSQLPNSMDGYGQAFVASEEQKLDWADMLFLTCLPISQRYVTLWPTIPTSFRETLDKYSLELQRVTTCLIGMMAKNLGIEPQKLTNIFENGLQGVRMNYYPPCPQANKVIGLSPHSDGSGLTLLIQVNEVEGLQIRKNGDWVPVKPIAGAFIVNIGDAVEILSNGKYKSIEHRAVINPEKERLSIAAFHNPNLSTMVGPLPELVKENGERYKTMKYEDYVKQVIASKLDGKSSLDAVKLEK

SEQ ID NO: 1196 - protein, 357 aa, Nandina domestica
MESETKEPKPLGGSLPVENVQALATKELKEIPHRYIRPEIESSVVSVDKSREIPVIDLGRLVSEQFSSDEMAKLQSACEDWGFFQLSNHGVSEEIIEKMKIDLRDFFNLPLEEKKACSQLPNNTEGYGQAFVVSDEQKLDWSDMLFIMTLPVPERNMRFWPKNPSSFRETMDKYSTELHRVTVCLTSLMAKNLGVEPEKLANMFESGSQSVRMNYYPPCAHADKVIGLSPHSDAVGLTLLIQANEVEGLQIRKNGNWIPVKPIAGAFVVNIGDVLEIISNGKYKSIEHRAVAHPEKERLSIAAFHGPNFNAMIGPLSDLVKESREHYKTIIHEDYVKQIFASKLDGKSTLDFMKLDK

SEQ ID NO: 1197 - protein, 354 aa, Nandina domestica
MNKAKELGGSISVDNVQALATKELKEIPHRYIRPELESDVVSIDESREIPVIDLCKLLDEEFASDELATLRSACEDWGFFQLVNHGASEEIIAKMKINIQEFFRQPLEVKKSFSQLPNSMEGYGQAFVVSEEQKLDWADMLFLVSSPISERNFTFWPTNPTSFRETLSKYSLELQRVTVRLVRFMAKNLGVEPDMLANMFANDGSQTIRMNYYPPCPQRDKVLGLSPHSDGSGLTLLIQVNEVEGLQIRKNGSWVPVKPVAGAFIVNIGDVIEIMSNGKYKSIEHRAVIDPVKERLSIAAFHGPNLNTMTGPLPDLVKKNEQRYMTVNYEDYVEQLVSSKLDGKSALDSMKLEK

SEQ ID NO: 1198 - protein, 358 aa, Nigella sativa
MATSNPVKYGSSKLVPCVQELAKQPMVTPPARYIRLDQEPSFVSALPLDAVPVISMQKLLYGDSMELELQRLHSACKEWGFFQLANHGVPEILVENIKKEIQEFFELPFEEKKKFWQSENEVEGFGQAFVVSDEQKLDWADIFFINTQPINSRKPHLFPNLPLPFRRTLDDYSLELKNLAMKILGWMEKALKIEGKEITELFKEGVQSMRMNYYPPCPESDKVIGLTPHSDSIGLTILLQVNEMEGLQVRKEGKWIPIKPLPNAFIVNIGDILEIVTNGVYHSIEHRATVNKVKERLSIATFYSPRFEAEMGPAKSLVTDQTPAMYRRIMVHEYFRQFFSRELGGRSFIEDMKIENED

SEQ ID NO: 1199 - protein, 366 aa, Nigella sativa
MGNKTNMREFGGSLPVQNVQALASQPLNQIPPRYLRPELLSDTVVTATDSDESLKIPVINFRRLLLDQQQQADDDGSYNEMDKFHAACRDWGFFQLINHGVADEVIEKMKMGTEGFFRLPLEEKNVYSQLPNNIEGYGQAFVVSEDQKLDWGDMLFFLSQPLHDRTLRFWPNTPSSYRETLDKYSAELQKLAVSLVEMMASNLGIIPEKLTDMFGIDGSQGLRMNYYPPCPHADKVIGLSPHSDGTGITLLLQVNQVQGLQIRKNGNWLPITPIPGAFIVNIGDIIEIMSNGAYKSIEHRAVINPEQERLSIAAFHGPRLGTPIGPLPCIVKEDEMKYKTVSHEDYLKQMINQKLDGKSVLDLMKL

SEQ ID NO: 1200 - protein, 384 aa, Papaver bracteatum
MFKNQPRNIFLVPDPPSIVFSNSPLFHSINQSMEVFVSGVQTLSETGVTHVPSQYIQPPQNRPHQPTITSSSDSLNIPIIDLSNFNPQHSNDVRTELGRACSDWGAFQITNHGISNSLIKDIIDVGLTFFNECSITEKSKYSCDPNSAASEGYGSRMLVNEDSVLDWRDYFDHHTFPLSRRNPNRWPDFPTNYRGVVEEYSNQIKELALKLMSMISESLGLQSSCIEDIVGEVYQNLTISYYPPCPQPELTLGLQSHSDIGAITLLIQDDVGGLEVLKDDKWVTVQPVSDAIVVILADQFEIMTNGKYRSAVHRAVTNSHRARLSVGTFHDPGKIRKIAPAAQLVDKDTLARYKEVVYGEYVSNWYSKGPEGKRNIDSLLLNQQ

SEQ ID NO: 1201 - protein, 369 aa, Papaver bracteatum
METPKSIKLGGSLLVPSVQELAQQSFAEVPARYVRDDLEPLTDLSGVSMIDQTIPVIDLQKLQSPVPIIRELESEKLHSACKEWGFFQVVNHGVDILLVEKTKSEIKDFFNLPMDEKKKFWQEEGDIQGFGQAFVQSEDQKLDWADIFLMVTLPRHTRNPRLFPKLPLPLRNTMDSYSSKLSKLASTLIEMMGKALHMETSVLAELFEDGRQTMRINYYPPCPQPKDVIGLTPHSDGGGLTILLQLNEVDGLQIRKEKIWIPIKPLPNAFVVNIGNILEIMTNGIYRSVEHRATIHSTKERLSVAAFHNPKVGVEIGPIVSMITPESPALFRTIEYDDYGKKYFSRKLDGKSSLDFMRIGEGDEENKAT

SEQ ID NO: 1202 - protein, 366 aa, Papaver bracteatum
METPKLIKLGGSLLVPSVLELTKQSPAEVPARYIRNDLEPMTDLSSASLTDQTIPVIDLQNLLSPEPELELEKLHSGCKEWGFFQVMNHGVDILLVEKVKSEIQGFFNLPIDEKNKFWQEEGDLEGYGKAFVHSEDEKLDWADMFFILTQPQYMRKPRVFPKLPLRLRETIESYSLELSKLGLTLLDLMGKALQIETGVMSELFEDGRQTMRMNYYPPCPQPEHVIGLTPHSDGGALTILLQLNQVDGLQIRKEEIWVPIKPLPNAFVVNIGDILEIMSNGVYRSVEHRATINSSKERLSVAIFQSPKHGTEIGPILSMITPEAPALFKTIPYEDYLRKFFSRKLGGKSFVDSMRIGESDEDNNTA

SEQ ID NO: 1203 - protein, 366 aa, Papaver bracteatum
METQKQENFGASLSVPNVQELAKQSPEQVPDRYIRSDQDSSTNISCPSMTDQIPVIDLQSLLSPDPIIGELELERLHSACKEWGFFQVVNHGVDNLLVEKVKSEIQGFFNLPMDEKKKFWQEEGDFEGFGQAFVFSEDQKLDWGDVFFILTQPQHMRKPRLFPKLPLPFRKTIESYSLETNKLSMTLLELMEKALKIETGVMTELFEGGIQRMRMTYYPPCPQPKHVIGLTPHSDPDALTILLQLNEVDGLQIRKEKIWVPIKPLSNAFVVNIGDILEIMSNGIYRSVEHRATVNSTKERLSVATFHSPRKDTEIGPILITPETPALFRTSGFEDYFRKFFAHKLNGKSFLSSIRIGETDEGNNAT

SEQ ID NO: 1204 - protein, 379 aa, Papaver bracteatum
MEAPKLIMLGGSLFVPSVQELAKQSLAEVPVRYVRDDQDTLGNNINITPMSMIDQSIPVIDLEKLLSPEPIVGELELERLHSACKEWGFFQVVNHGVDSLLVEKVKSEIEGFFKLPMDEKTKFWQEEGDIEGFGQVFVHSQDQKLDWGDMFLMQTLPRHTRKPRLFPNLPLPLRQTIESYSSELSKLVLTLVDLMGKALQMESGVLTELFENGIQRMRMNYYPPCPQPEQVIGLTPHSDVGGLTILLQLNEVDGLQIKKDKVWVPIKPLANAFVVNVGDALEIMSNGIYRSVEHRATINSTKERLSIATFHNPRADREIGPIPSMISPETPALFKTTGYEEYFKKFFSRKLEGKSFLDSLRIREGDEHCGRLDVKGPCN

SEQ ID NO: 1205 - protein, 365 aa, Papaver bracteatum
MEIPNPIKIGSSLLVPSVQELAKQSFAEVPARYIRNDVDPLITKLSDVSLIDQTVPVIDLQKLLSPEPIVGELELERLHSACKEWGFFQVVNHGVDNLLVEKVKSEIQGFFNLPMEEKKKFWQEEGDFEGFGQMFVQSEEQKLDWGDMFFILTQPQHMRKPRLFSKLPLPLRETIESYSLELIKLGLTIIKLMEKALQIDAGVMAELFEDGIHTMRMNYYPPCPQPEHVIGLTPHSDGGGLTILLQLNEVDGLQIRRENIWVPIKPLPNAFVVNIGDILEILSNGIYRSVEHRSTVNATKERLSVATFQNPKQESVIGPNMITPERPALFRKIVYKDYMKKLFSRKLDGKSFLDSLRIGEGDERP

SEQ ID NO: 1206 - protein, 362 aa, Papaver bracteatum
MGEVDAAFVQALEHRPNPNNIVEAGGIPLIDLSPLNDFCHSNDENSAHDSARHTDLVTKIGRACKEWGFFQVFNHGVSSDLQQGVEAAVKKFFDLSSEEKRKVKRDEVNPMGYYDTEHTKNVRDWKEVFDFTVKNPTLLPASHHLEDQELQELRNQWPDYPPELREVCEEYASALEKLSFELLKLIALSLGLPEKRLNGYFNDDHTSFIRFNHYPPCPEPHLALGVGRHKDAGALTVLAQDDVGGLDVKRKSDGEWVRVKPIPGSYIVNVGDIIQVWCNDKYESAEHRVTVNSKRERFSIPFFFNPSHHVMVKPLEELVDYQNPSKYKEYNWGKFFKTRKISNFKKLDAENIQIYHFKRSLV

SEQ ID NO: 1207 - protein, 349 aa, Papaver bracteatum
METLKTVKPGGSLFIPNGQELAKQSLEEVYVGNDQDTMLLIGQTIPVIDLQKLLSPEPITGDMELDKLHSACKEWGFFQVVNHGVDILLVEKVKSEVHDFFNIPMDEKKPFWQEEGDLEGFGQVFITSEDQQLDWGDMFFMVTLPKHMRKPRLFLKLPLPLRETIESYSLKLSKLGVTLVELMGKALQMEDRIMSELFDDGRQTMRMNYYPPCPQPEQVIGLTPHSDPGGLTILLELNEVNGLIRKENIWVPIIPLPNAFIVNIGDILEIMSNGIYHSVEHRATINSTKERLSVAMFNSPKVDTEIGPIHSMITPETPALFRTIGYDEYLKIFFSRKLDGKSLLESMKI

SEQ ID NO: 1208 - protein, 376 aa, Papaver bracteatum
MSYESLPPKVVVPSVHELIKEKITEIPNPYIRTSCVDHEDHHTDQSTADHNIPVIDVQGLLSGESVLADSEFEKLHSACQDWGFFQVVNHGISSLVIANLKSEMRNLFELPLEERKKICQEPGDPMAEGFGQLFIVSDDQKRDWSDTFYLTALPTKLRKPQLFAGIPVLMRESLEAYSSGLKDVTMILLGKMAKAIKMDSDEMEELFNDCLQRMGLNYYPPCPKSEQVIGLSPHSDAGALSIVLQLNETEGLQIRKDGKWVTVKPIPGALIVNLGDMIEILSNGAYPSIEHRVMVNPAIERLSIATFHATNPDAEFGPALSLIDPPHKPALFRRETVEKFYTNFFANKLNGKTTNLDFMRIQNGDQSSRLISGYRP

SEQ ID NO: 1209 - protein, 379 aa, Papaver bracteatum
  misc_feature (373)..(373): Xaa can be any naturally occurring amino acid
  misc_feature (377)..(377): Xaa can be any naturally occurring amino acid
MEAPKLIMLGGSLFVPSVQELAKQSLAEVPVRYVRDDQDTLGNNINITPMSMIDQSIPVIDLEKLLSPEPIVGELELERLHSACKEWGFFQVVNHGVDSLLVEKVKSEIEGFFELPVDEKKKFWQEEGDIEGFGQIFVHSEDQKLDWADMFYMLTLPPNMRKPRLFPNLPLPLRQTIDSYSSELSKLVLTLVDLMGKALQMESGVLTELFENGIQRMRMNYYPPCPQPEQVIGLTPHSDVGGLTILLQLNEVDGLQIKKDKIWVPIKPLRNAFVVNVGDALEIMSNGIYRSVEHRATINSTKERLSIATFHNPRADREIGPIPSMISPETPALFKTTGYEEYFKKFFSRKLEGKSFLDSLRIGEGDEHCGRLXVKGXCN

SEQ ID NO: 1210 - protein, 362 aa, Papaver bracteatum
METPKLMKLGGSLFVPSVQELAKQSLAEVPARYVRDDRDMVGNIINVTPMSMIDQSIPVIDLEKLLSPDLIVGELELERLHSACKEWGFFQVVNHGVDSLLVEKVKSEIEGFFELPMDEKKKFWQEEGDAEGFAQFFVQSEDQKLDYSGDMFFMLNLPQHMRKPRLFLKLPLPLRETIESYSLKLSKLGVTLVELMGKALQMEDRIMSELFDDGRQTMRMNYYPPCPQPEQVIGLTPHSDPGGLTILLELNEVNGLIRKENIWVPIIPLPNAFIVNIGDILEIMSNGIYHSVEHRATINSTKERLSVAMFNSPKVDTEIGPIHSMITPETPALFRTIGYDEYLKIFFSRKLDGKSLLESMKI

SEQ ID NO: 1211 - protein, 340 aa, Papaver bracteatum
MGRTVKDLTDTSDLISIPSEYVFPTNPEDLEEAEQQIPIIDYYLLTSGSPEQRSLIIENLRSACLEWGFFMVINHGVPQSLINEMMNLCLGFFDLSPNEKSDYVGKHVLNPIRCGTSFNTSVEKIYFWRDYLKILVHPEFHAPLKPHAFRDISYEYCKRSREVAKELLKAISESLGLEEDYIEKALETKSGLQILIVNLYPPCPQPELAMGMPPHSDHGLLTLLAQNEIGGLQIKHKGKWIAANALPNSFMVNIGDHMEILSNGKYKSILHRVAVNTKATRVTVVTANGPSLDAVVTPAPDLVDCENYPPLYRGMKYRDYVELQQSNQLDGKSCLDRILV

SEQ ID NO: 1212 - protein, 365 aa, Papaver bracteatum
METPKLRDFGSFLPVPSVQELAKQVLTEIPPRYIRTDLEALNKLSCASNTDQTVPIIDMQCLLSAEPEMELEKLHSACKEWGFFRVVNHGVDNLESVKSEIESFLNLPVNAKNKYGQKQGDDQGFGSRFVLSEEQKLDWGDFFYMVTRPLYLRKPHLFPELPLPLRETIESYSSEVSKLAMALFEMMGKALKIETGVMTEIFEGGMQAMRMNYYPPCPRPDLVIGLNAHSDFGGLTILLQLNEVEGLEIRNKGEWVSVKPLANAFVVNVGDVMEILTNGIYHSVEHRATINSSKERLSVATFHYPKLETGIGPLPCMITPKTPALFGRIERYELLLRKYYARKLNGKSTLDCMRIGNGFEDDNTA

SEQ ID NO: 1213 - protein, 368 aa, Papaver bracteatum
MSYESLPPKVVVPSVHELIKEKITEIPNPYIRTSCVDHEDHHTDQSTADHNIPVIDVQGLLSGESVLADSEFEKLHSACQDWGFFQVVNHGISSLVIANLKSEMRNLFELPLEERKKICQEPGDPMAEGFGQLFIVSDDQKRDWSDTFYLTALPTKLRKPQLFAGIPVLMRESLEAYSSGLKDVTMILLGKMAKAIKMDSDEMEELFNDCLQRMGLNYYPPCPKSEQVIGLSPHSDAGALSIVLQLNETEGLQIRKDGKWVTVKPIPGALIVNIGDMLEILSNGAYPSIEHRVVVNPTMERFSIATFHSTNPDAEIGPAHSLIDPPHKPALFRRETLKKYYQNFFAHKLNGKTTNLDFMRIRNGDLSS

SEQ ID NO: 1214 - protein, 368 aa, Papaver bracteatum
MSSSPMVVPLVRELVKENITEIPNRYIRPTSDLDHEYHHSDDDSTAAKYNIPVIDVEGGLLSGESVLADSELHKLHSACQHWGFFQVVNHGISSLVIANLKSEMRNLFELPLEERKKICQEPGDPMAEGFGQLFIVSDDQKRDWSDTFYLTALPTKLRKPQLFAGIPVLMRESLEAYSSGLKDVTMILLGKMAKAIKMDSDEMEELFNDCLQRMGLNYYPPCPKSEQVIGLSPHSDAGALSIVLQLNETEGLQIRKDGKWVTVKPIPGALIVNIGDMLEILSNGAYPSIEHRVVVNPTMERFSIATFHSTNPDAEIGPAHSLIDPPHKPALFRRETLKKYYQNFFAHKLNGKTTNLDFMRIRNGDLSS

SEQ ID NO: 1215 - protein, 373 aa, Papaver bracteatum
MSSSPMVVPLVRELVKENITEIPNRYIRTTCLDHEEDHSHRDDYDSAAAKYDIPVIDVQGGLLSGESVLADSELEKLHSACQHWGFFQVVNHGISSLVIDKLKLEIHNLFELPLEEKKKIWQEPGDMEGFGQQFVVSNEQKLDWSDMFYITALPTKMRKPQLFSRIPLSLREALEAYSWGLKNLNMILLGKMATALKMDSDEMEDLFSDCLQRMKMNYYPPCPKSQQVIGLSPHSDAGALSIVLQLNETEGLEIRKHGKWVPVKPIPGALVVNVGDMIEILSNGAYTSIEHRVMVNPTIERLSIATFHSINPDAEFGPACSLIDPPHKPALFRRETVKKYYKNFFANKLNGKTTNLDFMRIQNGDQSSRLISG

SEQ ID NO: 1216 - protein, 367 aa, Papaver bracteatum
MSSFGSSLIVPSVQELVKKEITEIPDRYIRTSSSNLSLDNEIHYSDSAAHEIPVINIGRLLSGEQTLADNELDKLHSACKDWGFFQVVDHGVSLSTIEKIKLETHNLFELPLEEKKKLWQTPGDHEGFGQLFVVSDEQKLDWSDMFFITMLPTILRKPHLFAGMPSPLREALEDYALGLEKLTMTILEQMAKALKMDSNEMRELFSGCYQTMRLNYYPPCPKAEQVVGISPHSDADALTIVLQLNETEGLQIRKDGKWIPVKPIHNAFVVNIGDIMEIVSNGVYRSIEHRAVVNSTKERLSVAAFHSANLDAEIGPAHSLISPPHKPALFRRESVETYFKNFFARKLDGKSYLASMRIDKVHGEQSS

SEQ ID NO: 1217 - protein, 370 aa, Papaver bracteatum
MEAPKLIMLGGSLFVPSVQELAKQSLAEVPARYVRDDQDTLGNNINITPMSMIDQSIPVIDLEKLLSPEPIVGELELERLHSACKEWGFFQVVNHGVDSLLVEKVKSEIEGFFELPVDEKKKFWQEEGDIEGFGQIFVHSEDQKLDWADMFYMLTLPPNMRKPRLFPNLPLPLRQTIDSYSSELSKLVLTLVDLMGKALQMESGVLTELFENGIQRMRMNYYPPCPQPEQVIGLTPHSEVGGLTILLQLNEVDGLQIRKEKIWVPIKPLSNAFIVNIGDILEIMSNGIYRSVEHRATVNSTKERLSVATFHSPRKDTEIGPILITPETPALFRTSGFEDYFRKFFAHKLNGKSFLSSIRIGETDEGNNAT

SEQ ID NO: 1218 - protein, 313 aa, Papaver bracteatum
MSMIDQSIPVIDLEKLLSPEPIVGELELERLHSACKEWGFFQVVNHGVDSLLVEKVKSEIEGFFELPVDEKKKFWQEEGDIEGFGQIFVHSEDQKLDWADMFYMLTLPPNMRKPRLFPNLPLPLRQTIDSYSSELSKLVLTLVDLMGKALQMESGVLTELFENGIQRMRMNYYPPCPQPEQVIGLTPHSDVGGLTILLQLNEVDGLQIRKEKIWVPIKPLSNAFIVNIGDILEIMSNGIYHSVEHRATINSTKERLSVAMFNSPKVDTEIGPIHSMITPETPALFRTIGYDEYLKIFFSRKLDGKSLLESMKI

SEQ ID NO: 1219 - protein, 382 aa, Papaver bracteatum
MMSAQDSWPEPITRVQAISESGSSVIPDRYVKPPSERPNTSTTSSTELLGLSIDTETSSNVDASDLNIPLIDFQGLLDDDEDNHLVLPDTILDQVCMASKNWGFFQIVNHGVSPELMDQVRDVWRQFFHLPFEQKQVYANTPATYEGYGSRLGVEKGAILDWNDYFYLHYLPQSLQDPNKWPALPLSCREVIAEYCKQLVKLSKKIMKILSITLGLEEDYLQNAFEGGEEFGACMRVNFYPKCPQPDLALGLSSHSDPGGMTLLLPDDDVVGLQVRKDDTWITVKSAPNSFIVNIGDQIQVLTNAIYKSVEHRVTVNSMNERLSLAFFYNPRGDLIIQPAKELVTLERPALYSPMTFNEYRRFIRTMGTRGKLQLESMKSPR

SEQ ID NO: 1220 - protein, 365 aa, Papaver bracteatum
METPKLVKSSGSSLFLSTSVQELAKQSLPEVPARYIRTNLEPLSNVSGDSQSVPVIDLQKLLSSEPIIGELELDKLHSACKEWGFFQVVNHGVDNLVMEKIKTEIQGFFNLSLDEKQKFWKKEGDAEGFGQNFIESEDQKLDWGDTFGMFTLPIHMRNPRLFPELPLPLRETIESYSLDVRKLALALIGLMEKALKIKTSAMSELFEDGGQAMRMNYYPPCPQPEHVIGLTPHSDAGGLTILLQLNEVDGLQIKKDKIWVPIKPLPNAFVVNIGDILEIMTNGIYRSVEHRATINSSKERLSVAAFHSPKGDTLIGPMVSLITPETPALFRTIGYQDYMKKFMSRKLDGKSLVNSMRIGEGDEDK

SEQ ID NO: 1221 - protein, 367 aa, Sanguinaria canadensis
MEKTQPILGTSLIVPSVQELAKQPLVEVPPRYLRPDQDPPIISQSDDSLVPITTVPVIDLQCLLSPEPIGDSELEKFHSACKEWGFFQLINHGVNSSLVEKVKSEIQDFFRLPIEEKNKYWQEEGEVEGFGQAFVVSTEQKLDWGDMFFMATLPLHLRKPHLFPKLPLPLRDTLESYSSELKKLTMALLVLMARALQIETKVTTELFEDGMQSMRMNYYPPCPQPEHVIGLTPHSDSSGLTILLQLNEMEGLQIRKEGRWVPVKPLPNAFIVNIGDILEIVTNGIYPSVEHRATVNSMKERLSVATFHSPNLTKETGPAPSLITPYRPALFRRVGNEEFWRERFRRELNGKSFLDFMKIGGGDGNTA

SEQ ID NO: 1222 - protein, 386 aa, Sanguinaria canadensis
MNSSSDSSVPKQQQQEEEVVKFGRTLLVPSVQELAKEQNTEIPHRYIRSGLDDEDCPANIVCDPTSSSFPTVPVIDIQTLLSGDISADSELETLHSACKDWGFFQVVNHGVSSSLIEKIKLEIHDLFELPFEEKRKLWQQPDDLEGFGQMFVVSEEQKLDWSDMFFIFTRPTTIRKSDLYTKLPLSLRETLEAYSLELKELAITILGRMAEALKMDSTEMRGLFNNGFQTMRLNYYPPCSQADKVLGFTPHSDADALTILLQLNETEGLQIRKDGKWIPVKPIPNAFVVNVGDIMEIVSNGVYRSIEHRAVVNSTKERLSIATFFSTNLDAELGPAHSLIDPPHKPALFKRVTVVKYYEDFFSQKLDKKSYIDFMRIENGQDNHSN

SEQ ID NO: 1223 - protein, 296 aa, Stylophorum diphyllum
MEALPKPPVLGNSMIVPSVQELASKSLVKVPPQYIQMLDHQDPPFIINEVLTVTSALPIIDLQTLLSHPETNNNNFDSELVKLHSACKKWGFFQLVNHGVNTSLLDKVKSEIESFFKLPMEEKKKYWQDEENFEGFGQAFVFSEEQKLDWADMFYMITLPRQARKHHLFPKLPGALRDALESYTSELQNIAMKLVEFIGRALEIETKVMNEFFKDGLQTMRMNYYPPCPQPELVMGLASHSDAIGISILFQLNEIEGLQIKNEGIWIPVKPLPNTFVVNLGDILEVTAYSNKWALS

SEQ ID NO: 1224 - protein, 370 aa, Stylophorum diphyllum
MEALPKPPVLGNSMIVPSVQELASKSLVKVPPQYIQMLDHQDPPFIINEVLTVTSALPIIDLQTLLSHPETNNNNFDSELVKLHSACKKWGFFQLVNHGVNTSLLDKVKSEIESFFKLPMEEKKKYWQDEENFEGFGQAFVFSEEQKLDWADMFYMITLPRQARKHHLFPKLPGALRDALESYTSELQNIAMKLVEFIGRALEIETKVMNEFFKDGLQTMRMNYYPPCPQPELVMGLASHSDAIGISILFQLNEIEGLQIKNEGIWIPVKPLPNTFVVNLGDILEILTNGLYRSVEHRVTVNSMKERLSVATFYSPKLEEVIGPLPCLINPHNPALFKTVGVEEYFKKRYSLKLNGKLTIDFMRIEGDTA

SEQ ID NO: 1225 - protein, 300 aa, Tinospora cordifolia
MDKAEGRAPVTLGKSLLVPSVQELARKPLATVPQRYVREDHQDDPSLLKHTCAPTSPLPSLPVIDLKCLLDSQSAGSELEKLHFACKDWGFFQLVNHGVSTWLVEKVKSQTQDFFNLSIEEKQKFWQQPGEIEGFGQAFVVSEEQKLDWADMFFMTTLPKYLRKPHLFPMLPLHFRETMEEYSLELKNLAMTILEMMAKALKIETEELKLLFDDGLQAMRMNYYPPCPQPEQVIGLTPHSDAVGLTILLQVNEMEGLQIRKDGMWVPVNPLPNAFVVNIGDILEVTTTYIYLYIYNIIII

SEQ ID NO: 1226 - protein, 360 aa, Tinospora cordifolia
MTSKAGEHGSLPVPNVQELASNDLKGVPSRYIRPELETHQVLSDESLEIPVINLQKLLNQQQMGTSDADGDDDNEMCRLHKACRDWGFFQLINHGVPEEIIEKMKSDTVEFFKLPLEEKKAYAQEPGNIFGYGQTFVVSEDQKLDWSDILVLLTLPVSDRIMKFWPTKPSSFRGTLDKYAKEMEKLTICLLDLIEKNLGIESGKLRNVYKGGLQRVRMNYYPPCPVADKVLGLSPHSDASLITLLTQVNEVEGLQIKKNGHWVSIKAIPGAFIVNLGDLLEILSNGMYKSIEHRGVIHPEKERLSIAGFQGAKSGVVIGPFPELLGENGANYRAIEHDAYLKQFFSSKLDGKRVLDLMKL

SEQ ID NO: 1227 - protein, 349 aa, Tinospora cordifolia
MKSLSLPVPNVQELASKSVKDEVPDRYIRRELESEHVSDESSDEIPVIDLQKLFSSDDEMTKLHIACKDWGFFQLINHGVEELIKKMVKNVEEFFHLPLEEKKAYAQQPGDSQGYGQAFVLSDDQKLDWSDMLSLTTLPISERNLRVWPKNPPSFSETLEKYVTEMQQLTFKLLSLIAKNLGVEEKKVTSVFDEGLQGVRSNYYPPCPRADKVIGISPHSDASIITLLIQNNEVPGLQIRKCGNWVPVKPIQGAFVVNVGDVLEILSNGLYRSIEHRAIIHPEKERISIAGFQDPNLGTVIGPIADLLDDKNFANYKTIRFDDYWGHYFSAKLDGKSVLNLMKLENNHA

SEQ ID NO: 1228 - protein, 362 aa, Tinospora cordifolia
MTSKAGEHGSLPVPNVQELASNDLKGVPSRYIRPELETHQVLSDESLEIPVINLQKLLNQQQMGTSDADGDDDNEMCRLHKACRDWGFFQLINHGVPEEIIKKMKDDTVEFFKLPLEEKQAFAQEPESFHGYGQAFVVSEEQKLDWSDMLVILTLPVSDRVMKFWPTNPPFRGIIEKYAEEMEKLTICLLGLIETNLGIEGGKLINTYKDGGLQWMRMNFYPPCPEADKVIGISPHSDASLITLLIQVNEVEGLQINKSGKWVPIKAIPGAFIVNFGDAIEVLSNGMYKSIEHRAVIHPEKERLSIAGFQDPKRGIVVGPFPELLEDGAKYKTVEYDEYLTQYFSRKLDGKSALDLIKLSEM

SEQ ID NO: 1229 - protein, 361 aa, Tinospora cordifolia
MEGKVTGKIGEYRSLPVPNVQEFAKNNLKEIPSRYIRPELETHQVSNIDESLEVPVINLLKLLDQQLLGTNDDDDEMGRFHKACRDWGFFQLINHGVPEEIIEKMKSDTVEFFKLPLEEKKAYAQEPGNIFGYGQTFVVSEDQKLDWSDILVLLTLPVSDRIMKFWPTKPSSFRGTLDKYAKEMEKLTICLLDLIEKNLGIESGKLRNVYKGGLQRVRMNYYPPCPVADKVLGLSPHSDASLITLLTQVNEVEGLQIKKNGHWVSIKAIPGAFIVNLGDLLEILSNGMYKSIEHRGVIHPEKERLSIAGFQGAKSGVVIGPFPELLGENGANYRAIEHDAYLKQFFSSKLDGKRVLDLMKL

SEQ ID NO: 1230 - protein, 365 aa, Thalictrum flavum
MEGSKQVSFASKLVPNVQELAKQPIDSIPPRYVRTDLDNPTIVSVDPASTPTIPVIDMEKLLDGDNMDSETDKLHTACKDWGFFQLVNHGVDTTLVEKAKHEIQEFFGLPIEEKRKFWQKENEVEGFGQVHVVSDEQKLDWGDMFFMYALPINARKPHLFPKLPLPFRDIIDAYSQEMKLLAMKILGMIEKVLKMDAKEITQLFEDGRQSMRMNYYPPCPQPEKVIGLTPHSDAGGLTILLQINEIEGLQVRKNGIWIPIKPLPNAFIVNIGDILEIGTNGIYRSVEHRATVNSTKERLSIATFHNPSLQDEICPLPNLITSDRPAMFRSIMTEEYNTKLLTRALDGKSLLDSLRIEAKCEDDGN

SEQ ID NO: 1231 - protein, 358 aa, Thalictrum flavum
MEGSKQVSFASKLVPNVQELAKQPIDSIPPRYVRTDLDNPTIVSVDPASTPTIPVIDMEKLLDGDNMDSETDKLHTACKDWGFFQLVNHGVDTTLVEKAKHEIQEFFGLPIEEKRKFWQKENEVEGFGQVHVVSDEQKLDWGDMFFMYALPINARKPHLFPKLPLPFRDIIDAYSQEMKLLAMKILGMIEKVLKMDAKEITQLFEDGRQSMRMNYYPPCPQPEKVIGLTPHSDAGGLTILLQINEIEGLQVRKNGIWIPIKPLPNAFIVNIGDILEIVTNGICRSIEHRATVNKLKERISVATFYSPKFDREMGPAHSLVTEKNPALFRRIVVEDYMKGFFARKLVGKSNLDVMRIDN

SEQ ID NO: 1232 - protein, 361 aa, Thalictrum flavum
MSTTVMQAEWPEPIVRVQSLAESGLSVIPERYVKPPSQRPKLDLVVDHEINIPIIDLSGLEGDDDQLRKTILNQISVACRDWGFFQVVNHGVKPKLMHEAREAWRDFFHLPVEEKQIYANSPKTYEGYGSRLGVEKDAILDWCDYFFLHYRPQLLKDHNKWPAFPVSLRNLIEEYNSELVKLSGRLMKILSVNLGLDEEYLQNAFGGENIGVCMRVNFYPKCPQPDLALGLSSHSDPGGMTLLLPDHSVSGLQVRKGDKWVTIQPAPDAFIINIGDQIQVLSNAIYKSIEHRAIVNSVKERISIAFFYNPKSDLLLEPASELVTQDQPALYLPMTFDQYRLEIRTRGPRGKAYMESLKSPR

SEQ ID NO: 1233 - protein, 361 aa, Xanthoriza simplicissima
MTKNLNNLGGSLPIDNVQSLAGTELKDVPERYVRPELEYDNDVVSTDKEDVEIPVIDLSRLLNQKFASDELAKFHSACLDWGFFQLINHGVSEEVIEKMKVDMEDFFRLPLEEKNVYGQLPNSTEGYGQSFVKSDEQKLEWADMHLLITKPVQERNMRFWPNTPTSFRATVDKFSTDVQKVAMCLIGMMAKNLGLESQVLTKPFENCIQCVRMNYYPPCPNFDKVLGLTPHSDASSLTLLLQVNQVNGLQIKKHGKWFPIKPILGAFVVNIGDILEIMTNGIYKSIEHRVVINPDKERLSIAIFHDPEFAAIIGPVQDLVRKYGARYKSISHADYLNQSINNKLDSKTFLGKFKLINNERE

SEQ ID NO: 1234 - protein, 362 aa, Xanthoriza simplicissima
MEAREVVSFGSSLIVPSVQELAKEQIDLISPRYIRSDQQDHPIFLDPSLLSTVPVIDMKILLAHDSAESIHSELEKLHYACKHWGFFQVVNHGIDSILIEKMKSEIQDFFKLPYDEKKKLWQQPGNHEGFGQLFVVSEEQQLDWSDMFYITTLPNSLKQPSLFAKIPLPLRETLEAYSLELKTLARTILGKMAEALEMDTEEMKELFSDGVQSIRFNYYPLCAQPEQVLGFTPHSDADALTILLEVNETEGLQIRKDGKWIPVKQVPNALVVNVGDIMEIVSNGVYRSIEHRAIVNSVKERLSVATFYSTNVDAEIRPAPSLITAKNPASFRTVPVEKYFKELYARKLDGKSYLDFMRIENC

SEQ ID NO: 1235 - protein, 545 aa, Argemone mexicana
MKKMIPNSSSSSILSVLVLLLFSTSSWAANSIHEDFLNCLSIYKSSFPIPIYTSKNSSFNTLFRSSARNLRFLSPNSTQKPEFIITPTLESHVQTTVVCSKKHGLDLKVRSGGHDVEGLSYVSDSPYVMIDLVDFRNITVNVKNATAWIQAGSSLGEVYYKVGNESKNTLGFPAGFCPTVGVGGHISGGGFGSLVRKYGLASDQVIDARIVTVNGEILNKKTMGKDLYWAIRGGGANNFGVLLSWKVKLVPVTPIVTVATIDRTLEQGATNLVHKWQFVADRLHEDVYIGLTMVTANTSRAGEKTVVAQFSFLFLGNTDRLLQIMEESFPELGLKRNDTTEMSWVESHVYFYRRGQPIEFLWDRDHLTKSFLKVKSDYVREPISKLGLEGIWKRYVGGDSPAMLWTPFGGRMNQISEFESPYPHRAGNIYNIMYVGNWLNENESEKQLNWMRSFYSYMGRYVSKNPRSAYLNYKDLDLGVNDNNVSEYIRYLKARSWGRKYFKNNFEKLVKVKSMVDPDNFFKNRQSIPPIRSWGKELEAINIVI

SEQ ID NO: 1236 - protein, 535 aa, Chelidonium majus
MMRISSSVTLSFLSFFVLLFSTSSLAATSNSDHGDFLQCLALHKPSTPIPIYTPSNSNFTTLFRSSARNLRFLSPNSTQPQFIITPTHESHVQAAVVCCRKHGLDLKVRSGGHDVEGLSYWSDAPFVIVDLVNFRNITVDVKAKTAWVQAGASLGEVYYKAANASNTLGFPAGFCPTVGVGGHISGGGIGALVRKYGLASDQVIDARIVTVDGKILDKKTMGKDLFWAIRGGGASNFGVILSWKVKVVDVTPIVTVGTVSRTLEQGATDLVYRWQFIADRLHEDLYLASTMTVANGSRAGGKTVLVNFFFVFLGDTDRLLRLMEESFPELGLNRSDCNEMSWVESHVFLYAPGRPVEYLWDRDHETKSFLKIKTDYVREPISKAALEGIWIRFMGGQSPAMLWTPMGARMNEISESELPYPHRAGNIYNIMYVGNWQQESESEVMLDWMRRFYRHMGRYVSKNPRSGYLNYKDLDLGQSESGDSEAMSYIRARSWGRKYFKGNFERLVKVKSMVDPGNFFKNKQSIPPIKSWGKN

SEQ ID NO: 1237 - protein, 528 aa, Corydalis chelanthifolia
MGISRIRVVVVVSSLLSILVLSNISLATSAASVNENFLECLSLQKTPIPIPTYSPNNFSYSTIFNSSARNLRFLSPTSEKPRFVITPLHESHVQAAVVCCKKHHLELKVRSGGHDLEGLSYTSETPFVIADLVNYRNISINVEDKSAWIQAGAQLGEVYYRIAEKSKTLGFPAGFCPTVGVGGHISGGGFGGLVRKYGLASDQVIDARMVDANGNILDKESMGEDLFWAIRGGGASNFGVILSWKVKLVPVTPNVTVAIVDKTLEQGATSLVYKWQQIADKLHEDLYISPTMSTVNASRGGQRTVLVQFSILFLGGIDRLLQLTQQSFPELGLQRKDCTEMSWVESHVYFYARGRPLELLLDRDHVTKSFLKVKTDYVKEPISITGLEGIWRKFLEGDAPVMLWTPFGARMNEISESESPYPHRAGNMFNIMYIANWQDDRESQKHIDWIRRFYSYMGSYVSKFPRAAYLNYKDLDLGEHRYGPLINSLTARNWGNKYFKSNFERLVYVKSKVDPSNFFKNKQSIPTF

SEQ ID NO: 1238 - protein, 544 aa, Eschscholzia californica
MKMGISSSPSSSSTLSLLSLLLVFFISLTSSWATHSNSLHGDFIQCVLSQHLYSSIKVPIYTPQSSNFTSLFRSSARNLRFLSPNLTKPQFIITPTHESHIQAAIICCKKHGLDLKVRSGGHDVEGLSYVSDTPFVIVDLVDFRNITVDVKSKTAWVQAGASLGEVYYAVANKSKTLGFPAGFCPTVGVGGHISGGGFGALVRKYGLASDQVIDARFINAEGKILDKRTMGDDLFWAIRGGGAANFGIIVSWKVKLVDVTPIVTVATVNRPLEQGATNLVHRWQFIADRLHEDVYIGLTLIVANGSRAGGKTVIAQFSFMFLGRTDRLLSLMEESFPELDLKRTDCNEMSWVQSHVYFYAPNRTIEFLWDRDHVTKSYLKIKADYVREPISKAGLEGIWKIFMTGDSPAMLWTPMGARMNEISEFETPYPHRAGNIYNIMYVGNSAQATESENQVNWMRRFYQYMTPYVSKNPRSAYLNYKDLELGQNRKNDSEAMAYIRARNWGRKYFKGNFERLVKVKSMVDPSNFFKNKQSIPPLHSWGKH

SEQ ID NO: 1239 - protein, 537 aa, Glaucium flavum
MGISSFATLSFLSFLVLFSIGSSAANSNSVHGDFLQCLSSLNQTSTPITIYTPSNSNFTELFRSSARNLRFLSPNSTQPQFIITPTHEYHVQAAVLCSRKHGLDLKVRSGGHDVEGLSYWSDVPFIIVDLVNYRNITVDVKAKTAWVQAGASLGEVYYQVANASKTLGFPAGFCPTVGVGGHISGGGFGALVRKYGLASDQVIDARIVTVDGRILDKRNMGKDLFWAIRGGGASNFGVILSWKVKLVEVTPIVTVATVGRTLEQGATDLVHKWQFIADRLHEDIYIGLTMTVANGSRAGEKTVLAQFSFMFLGGTDRLLRLMHESFPELGLNRSDCSEMSWVESHVYFYAPGRPVEYLWDRDHVTKSFLKIKADYVREPISKSGLEGIWRRFMGGQSPAMLWTPMGARMNEISEFELPYPHRAGNIYNIMYVGNWVEENESEKQIDWMRRFYNYMGRYVSKNPRSAYLNYKDLDLGQNENSDSEAMRYIKARTWGRKYFKGNFERLVKVKSMVDPGNFFKNKQSIPPIKSWGIEAGD

SEQ ID NO: 1240 - protein, 535 aa, SACFADX1
MGISSSATLSFISFLVLLFSSTASLAANSTSVHGDFLQCLSIHNSSVPIPIYTPNNSNFTTLFRSSARNLRFLSPNSTQPQFIITPTRESHVQAAVVCCRTHGLDLKVRSGGHDVEGQSYWSDVPFVIVDLVDYKNITVDVESKTAWVQAGASLGQVYYEVANKSKTLGFPAGFCPTVGVGGHISGGGFGALVRKYGLASDQVIDARIVTVDGKILDKETMGKDLFWAIRGGGASSFGVILSWKVKLVDVTPIVTVATVGRTIEQGATDLVHRWQFIADRLHEDVYIGLTMTVANGSRAGEKTVLAQFSFMFLGGTDRLLGLMGESFPELGLNRSDCKEMSWVESHIYFYAPGRPIELLWDRDHLTKSFLKIKADYVREPISKDGLERIWIRFMGGQSPAMLWTPMGARMNEISESELPYPHRAGNIYNIMYVGNWLQESESEQQIDWMRRFYNSMGRYVSKNPRSAYLNYKDLDLGQNENGASEAMRYIKARTWGRKYFKSNFERLVKVKSMVDPDNFFKNKQSIPPIKSWGKN

SEQ ID NO: 1241 - protein, 533 aa, Stylophorum diphyllum
MGISSSATLSFVSFLVLIFSTSSLAANSSVHDDFLQCLSLHKPSTPTPIYTPSNSNFTTLFRSSARNLRFLSPNSTQPQFIITPTHESHVQAAVVCCRKHGLDLKVRSGGHDVEGLSYWSDAPFVIVDLVNYRNITVDVKAKTAWVQAGASLGEVYYKVANASNTLGFPAGFCPTVGVGGHISGGGIGALVRKYGLSSDQVIDARIVTVDGKILDKKTMGKDLFWAIRGGGASNFGVILSWKVKVVDVTPIVTVGTVSRTLEQGATDLVYRWQFIADRLHEDLYLASTITVTNGSRAGGKTVLVNFFFMFLGDTDRLLRLMEESFPELGLNRSDCNEMSWVESHVYFYAPGRPVEFLWDKDHETKSFLKIKTDYVREPISKAALEGIWERFMGGQSPAMLWTPMGARMNEISESELPYPHRAGNIYNIMYVGNWQQESESEQQIDWMRRFYRHMGRYVSKNPRSGYLNYKDLDLGQSESGDSEAMSYIRARSWGKKYFKGNFERLVKVKSMVDPSNFFKNKQSIPPIKSWGKN

SEQ ID NO: 1242 - protein, 539 aa, Thalictrum flavum
MKISKFQLLSIIMFMTTCSISLLDLASSSPNYESFLQCFDTYSNFSIPIHSPTSSSYTSILHASIYNLKFKSPTIPKPKFIITPMHESHVQVTVVCCRQHGLQIRTRSGGHDFEGLSYVSDVPFVLLDLIHLRKISVNIEDNTAWVQTGATLGELYYRIAEKSRTHAFPAGLCPSVGVGGHISGAGYGILMRKYGLSADHVVDARLVDVNGRILDKESMGEDLFWAIRGGGASSFGVVLSWKIKLVPVPQTVTFFIVPRTLEQGGSALVHKWQFIGDKLTEDLFLGLSIQAMHLDGDHNGKKTILISFLGHYLGPMEKLLQLMEENFPEMQLKKEDCIEMSWIKSAVYFGVFTLESNLNILLERKNPFPPKGRYLTKSDYVQEPMSENALEGIWKRFHEIDEPEIIMSPYGGRMNEIEESAIAFPHRKGNMYKINYIALWKEEGDEAERKHASWIRELYSYMTPYVSKSPRCAYLNFKDIDLGHKRNGTATYLEAKVWGNKYFKNNFDKLVNVKTRIDPDDFFTNDQGIPPLPSLAEDK

SEQ ID NO: 1243 - protein, 529 aa, Hydrastis canadensis
METSSFLMISFLVFTTFCVPSASIHHENFLQCLDLHSNSSIPIYTPNSPSYLSILHASIYNLKFKSPSTPKPNFIITPMQESHVQAAVVCCKKYNLQLRTRSGGHDFEGLSYVSYVPFVLLDLIHLRSINVNIEDNSAWVQTGATLGELYYRIAEKSRTHTFPAGLCPTVGVGGHISGAGYGALLRKYGLSADHVIDARLVDVNGRILDKESMEEDLFWAIRGGGGASFGVILAWKLRLLPVPPTVTIFILPKTLEQGATSLVHKWQFVADNLHEDLFLGLSIQTMNIDDDRRKGEKTILVSFFCLYLGGVENLVQMMKQSFPELGLKKDDCLEMSWIRSAVYFGVYSNERSLSVLLERKNPVPPKMHYMVKSDYVKEPFSENVLEGIWKFFYEVDMPEIIMSPYGGKMSEISETAIAFPHRKGNLYKINYLVSWNEEGDEVSEKNANWIRELYKYMTPYVSKNPRASYLNFKDIELGHKKNGSATYLEAKVWGSKYFMKNFDRLVSVKTKVDPDDFFTNEQGIPPLSS

SEQ ID NO: 1244 - protein, 534 aa, Xanthoriza simplicissima
MGISSFVVLFPFLVFIALASSSSSQDEGFLQCLDLHSNSSIPVYNPSSSSYTSILHASIYNLKFISPATPKPYFIITPMRESHVQATVVCCREHGLQIRTRSGGHDFEGLSFVAHVPFVLLDLIHLRTISVDIEDETAWVQTGATLGELYYRIAEKSRTHAFPAGLCPSVGVGGHISGAGYGILLRKHGLSADHVIDARLVDVNGRILDKESMGEDYFWAIRGGGGASFGVILAWKIRLVPVPPTVTTFIVPRVLEQGATALVHKWQFIADKLDDDLFLGLSVQAMHLDPDHPEKKTVVISFLGFYLGAAEKVLQLIDESFPELGLMKADCIEMSWIRSAVYFGIFQLENNLSLLLERRNPIPPKNRYMTKSDYVQEPVSEDVLEGIWKRFYEVDEPEIIMSPYGGKMNEIEESAIAFPHRKGNMYKINYLVSWKELGEEAEKKHASWIRELYNYMTPYVSKSPRCSYLNFKDIDLGHKKNGTATYLEAKVWGSKYFKNNFDRLVSVKTKVDPDDFFTNEQSIPPLPSLAEPKK

SEQ ID NO: 1245 - protein, 517 aa, Nigella sativa
ATSSMVAVLALLLTFSLATSASVHESFLQCLGSEPSTPLYTPNTSSYTSVLQFSVRNFRFSTSSTPKPDLIVTPLDESQVQAVVVCSRKHGLMMKIRSGGHDYEGLSYVSDVPFIILDLINLDSISVDANKGTAWVQSGASIGQLYYRIAEKSRTYGFPAGVCTTMGVGGHFSGGGYGSLMRKYGVAADHIIDARIVNVDGKILDRRTMGKELFWAIRGGGGSSFGVVLSWKIRLVPVPPTLTVFRLFKTLEQGATTLLERWQYVAHKLPREIFFQVLVRTENSTDGKNTRRIQASFQSVFLGKAEKLVPIMEQHFPELGLKQDDCIEMSWIQSTLWLLGLPADGSLEVLLNRSSLTFDTFKAKTDYVTEPISVAGIEGVWKFVLEQNRPLLLLTAYGGRMSKIPESSIPFPHRKGNLYKLAQVVYWEGEGTEEINWIRRLNRYLTPYVSKSPRATYVNYNDLDLGQSKNGTSSYSAARAWGNKYFKNNFDRLVKVKTKVDPDNFFRNAQSIPTSVK

SEQ ID NO: 1246 - protein, 460 aa, Mahonia aquifolium
  misc_feature (147)..(147): Xaa can be any naturally occurring amino acid
PKPNFIVTPMQESHVQTSVICCRKHGLQMRIRSGGHDFEGLSYVSNVPFVVLDLIHFRTIRVDIEDNSAWVQTGATIGELYYRIAEKSRVHAFPAGLCPTVGVGGHISGAGYGVLIRKYGVSADHVIDARIVNADGEILDRESMGEXLFWAIRGGGGASFGVILAWKIRLVPVPPTVSIFIVSKTLEEGANALLHKWQFIGDNVHEDLYIGISMRREIISPKGDKTILVSFIGHFLGGSEKLVQHMEQSFPELGVKPNDCVEMSWIKSAVVFGVFSNDALLNVLLDRKNPFPPKSYHKVKSDYVAEPLPVTVLEGILKRFLKNGIDKPEIILSPYGGRMNEISESEIAFPHRKGNLYKINYIAEWEEAGSMEKHLSWIRELYEYMTPYVSKSPRSSYLNFKDIDLGQMKNGTATYSQAKAWGSKYFKNNFKRLVQVKTKVDPNNFFFNEQGIPPFHHRAN

SEQ ID NO: 1247 - protein, 531 aa, Nandina domestica
MGSSNFATLSFLCIFLLLVSTSSCADEENFLQCLDFHSQNSIPVYTPNTSSYRSILESPIYNLRFLSSTFRKPLFIVTPMQESHVQTTVTCCKKHGLQLRVRSGGHDFEGLSSISTVPFVILDLVHHRSINVDIEDNSAWVQAGATIGELYYRIAEKSKVHAFPAGLCPTVGVGGHISGAGYGVLIRKFGVSADYVLDARIVNADGEILDRKSMGEDLFWALRGGGGASFGVILAWKIQLVHVPPTVTIFIIPKTLEQGATSILHKWQFIADNVDEDLFIGISIRPEDKVDPKEGKTILVSFLGIFLGGPEELLQHMDHSFPELGLKRHDCIEMSWIKSAVVFGVFSTEVPLNALLDKKNPFPPKSFHRVKSDYVKEPLSVTVLEEIWRRFLEMGVHKPEIIMSPYGGRMNEISESAIAFPHRKGNIYKINYIIEWFDEETNTAKKHTSWIRDLYKYMTPYVSKSPRASYLNFKDIDLGHTKNGTASYSEAYKAWGSKYFKNNFKRLTQIKAKVDPNNFFWNEQGIPLLSS

SEQ ID NO: 1248 - protein, 531 aa, Berberis thunbergii
MFVVVASSIFTTFSLLSLLLPTSLASSDANYEDFLQCLDLYSQNSIPVYTRNTSSYTSILESTIKNLVFLSPTTPKPNFIVTPMQESHVQTSVICCRKHGLQMRIRSGGHDFEGLSYVSNVPFVVLDLIHLKTINVDIEENSAWVQTGATIGELYYRIAEKSRVHAFPAGLCPTVGVGGHISGAGYGVLMRKYGVSADHVIDARIVNVDGEILDRESMGEDLFWAIRGGGGASFGVILAWKIRLVPVPPTVTIFIVPKTLEEGATALLHKWQFIGDNVHEDLYIGLSMRSVIISPKGDKTILVSFIGLFLGGSDKLVQHMEQSFPELGVKPHDCIEMSWIKSTVAFGVFSNDAPLSVLLDRKNPFPPKSYHKVKSDYVTEPLPISVLEGICERFLKNGVDKPEIIMSPYGGRMNDISESEIAFPHRKGNLYKINYIAEWEEAGSMENHLSWIRELYKYMTPYVSKSPRSSYLNFKDIDLGQTKNGTATYSQAKAWGSKYFKNNFKRLMQVKTKVDPNNFFSNEQGIPPFSS

SEQ ID NO: 1249 - protein, 531 aa, Jeffersonia diphylla
MAFSDSSTVTLLSMILTFTISWAASDSSHENFLQCLDVHSQNSIPVYKPNTTSYTSILKSSVYNLKFLSSTTAKPLFIITPMHEAHVQTTVVCCRKHRLHIRIRSGGHDFEGLSYVSSAPFVILDLFHLKSIDVDIEDNSVWVQAGANIGELYYRIAEKSKVHAFPAGLCPTVGVGGHISGAGYGVLVRKYGVSADYVVDARIVNVDGEILDRKSMGEDLFWAIRGGGGASFGVILAWKLQLVHVPANVTIFIVPKTLEQNATALLHKWQFIGDNIHEDLFIGISIRPEEVAPNGEKTILVSFLALFLGGTEKLLPLMEESFPELGLKPEDCIEMSWIKSAVTFGVFSNEASLNVLLDRKNPFPPKSFHKIKSDYVKEPLPIAALEEIWRKFLEVGVEKPEIIMSPYGGIMNEIPESAIAFPHRKGNIYKINYIVEWLEEGTEATNKHETWIRELYSYMTPYVSKSPRASYLNFKDIDLGQTKNGSASYSQAKGWGNKYFKNNFKRLVHVKTKVDPDNFFWNEQGIPPQSS

SEQ ID NO: 1250 - protein, 530 aa, Menispermum canadense
MSTSIPSIFTLFCVLLISISRASSSSAHQNFLQCLSLHSDQSPIPVYTPNTSSYSSILQYSIQNLRFITPTTPKPQLIVTPSHDSHVQAAVICCRKHGLQIRVRSGGHDYEGLSYMSDVPFVIVDLITFQSIDVDLEDGSAWVQAGATIGQVYYRIAEKTRAYGFPAGGCPTLGVGGHFSAGGFGSLFRKYGLAADNIIDARLVNADGQILDKESMGEDLFWAIRGGGAASFGVILSWKIKLVPVPPTVTIFSIGKSLEQGATALVHRWQYIAYELPKDLLLAVFMRRVNASQEREGTVQATFLSVFQGRTEQLLHIMDQRFPELGVKSEDCMEMSWIQSSLYLAGFPIDGPADVLLQRNQSRRFFKAKSDFVKEPIPETALEGIWKRFYEVETPEMILVPYGGRMSEIPESELPYSHRKGNMYSIQYLAWWEQEGPKADTKNVNWVRRWYRYMAPYVSKSPRSAYLNYRDLDLGQSKNGTASYSQARVWGIKYYNNNFDRLVQVKSKVDPDNFFRNEQSIPSVPARKEK

SEQ ID NO: 1251 - protein, 541 aa, Cocculus trilobus
  misc_feature (268)..(268): Xaa can be any naturally occurring amino acid
  misc_feature (279)..(279): Xaa can be any naturally occurring amino acid
  misc_feature (316)..(316): Xaa can be any naturally occurring amino acid
  misc_feature (349)..(349): Xaa can be any naturally occurring amino acid
  misc_feature (479)..(479): Xaa can be any naturally occurring amino acid
  misc_feature (532)..(532): Xaa can be any naturally occurring amino acid
  misc_feature (539)..(539): Xaa can be any naturally occurring amino acid
  misc_feature (541)..(541): Xaa can be any naturally occurring amino acid
ISSTLLVSIFHILVFSISFSASNSPNYESFLSCLSNHSLDHSHIPIYLPNTSSYNSILNSSIRNLRFSSPQTPKPHLIIKPLHESHVQAAVICSKKHSFQIRTLSGGHDYEGLSFTSHLNLPFVILDLFNFQSINVDVKDETAWVQSGATLGQLYYKIAEKSLIHGFPAGICTTIGVGGHFSGGGYGTLKRKYGLAADNIIDARIVNSNGEILDRESMGEDLFWAIRGGGAASFGVVLSWKIKLVQVPPTVTVFAISKTVEQGAISLXHKWQYIAHKLXEDLMLLVQLRRANSTTQASFRSLFLGRKEQLLQIMQXSFPELGLKREDCIETSWIRSTLFFFDQPFNGSXSILLDRNSIPKVFAKIKSDFVKKPISEAGLQGIWRRYSEVDDPVTLITPYGGKMVEIAESAIPFPHRNGNIYLIGYEVDWTKGGAEASTKHIGWIRNLYEYLTPYVSKSPRASYLNYRDLDLGENRIDGXASYEEAKVWGVKYFKSNFDRLVEVKSKVDPDNFFSYEQSIPPLPNKGASTAYXTFVYLCXKX

SEQ ID NO: 1252 - protein, 528 aa, Tinospora cordifolia
MILLSHIFLFSISWWSSVLAQENFLQCLSLHSDQPPIPVYTPNTILLNSINPPIIPIQNLRFISSDTPKPQVIITPSHESHVQAAVICCRKHGLQIRVRSGGHDYEGLSYTSDVPFVVVDLANFESIVVDVEDRSAWVQAGATIGQVYYRIAEKTSAYGFPAGACPTVGVGGHFSAGGYGGLFRKYGLAADNIIDARIVTVDGKISDKESMGEDLFWAIRGGGGGSFGVILSWKIRLVPVPPVMTLSTVSRRLEQGATELVYKWQNIAHKLPEDLVFAVFIRRVNGSEETNDKIQAIFLSVFQGRTKQLLQIMEQKFPELGLKSEDCIEMSWIQSALYLAEFPFDGPRDVLLNRNQRRRLFKAKSDYVKETIPEIGLKGIWTFFNEVDIPEMILSPYGGRMSEISESALPFSHRKGNLFKIQYIAWWEKAGAEESKKNINWIRRLYKYMTPYVSKSPRSAYLNYRDLDLGHSENGTASYDQARVWGIKYFGNNFDRLVHVKSKVDPENFFRNEQSIPSVPEMIMNTES

SEQ ID NO: 1253 - protein, 521 aa, Cissampelos mucronata
MGISIWRLSLFQILLFIISSAASAGRENIFQCLSNHSTQSPIPLYVSNTPSYSLILQSSIQNLLFLSPKTPKPLFIIAPLHESHVQAAVICCRKHGLQIKIRSGGHDFEGLSYISYVPFVILDLFNLKSISIDVEDQTAWVQAGATLGELYYKIAEKTPTLGFPAGICPTVGVGGHLSGGGYGYLMRKYGLAADNIVDAQIVNVEGEVLNRESMGEDLFWAIRGGGGANFGVILSWKIKLVPVPPTVTIFRVPKTLDQGANGLVHKLQYIAHKLPKDLMLEVLTGRANASQAGKKTILIIFQALFLGGREQLLRIMEQSFPELGLKVEDCAEISWFQSALNFSGLPMNATLSTLAVNPFKGSYKIKSDYVKDPISESGLQGIWKNLLEADRLNVLITPYGGRMSEIAASETPFPHREGNIYQISYLVSWNKEEAAEKSIGWLRKLYKYMEPYVSKSPRSAYLNYRDIDLGHEFKNGTSSYARAKVWGSSYFGNNFDRLVQVKSKVDPYNFFRNEQGIPPVN

SEQ ID NO: 1254 - protein, 193 aa, Papaver bracteatum
MMRKVIKYDMEVATSADSVWAVYSSPDIPRLLRDVLLPGVFEKLDVIEGNGGVGTVLDIAFPPGAVPRSYKEKFVNIDRVKRLKEVIMIEGGYLDMGCTFYLDRIHVVEKTPNSCVIESSIIYEVKEEFADKMAKLITTEPLQSMAEVISGYVLKKRLQVFGFEIKPNLRFNLLLCLIICLVIAGGMLIGRVP

SEQ ID NO: 1255 - protein, 210 aa, Thalictrum flavum
MMKMEVVFVFLMLLGTINCQKLILTGRPFLHHQGIINQVSTVTKVIHHELEVAASADDIWTVYSWPGLAKHLPDLLPGAFEKLEIIGDGGVGTILDMTFVPGEFPHEYKEKFILVDNEHRLKKVQMIEGGYLDLGVTYYMDTIHVVPTGKDSCVIKSSTEYHVKPEFVKIVEPLITTGPLAAMADAISKLVLEHKSKSNSDEIEAAIITV

SEQ ID NO: 1256 - protein, 371 aa, Papaver bracteatum
MMRKVIKYDMEVATSADSVWAVYSSPDIPRLLRDVLLPGVFEKLDVIEGNGGVGTVLDIAFPPGAVPRSYKEKFVNIDRVKRLKEVIMIEGGYLDMGCTFYLDRIHVVEKTPSSCVIESSIVYEVEEEYADAMSKLITTEPLKSMAEVISNYVIQKESVSARNIFNRQSVVKKEIHYDLEVPTSADSIWAVYSNPDIPRLLRDVLLPGVFEKLDVIEGNGGVGTVLDIVFPPGAVPRCYKEKFVTMDHQKRLKEVIMIEGGYLDMGCTSYLDRIHVIEKTSKSCIIKSSVVYEVKQECAEAISKLITTEPLKSMAEVISNYVLKKQSVSDTNNIAKKQSVLRKEITYETEVQTSADSIWNVYSSPDIPPTT

SEQ ID NO: 1257 - protein, 320 aa, Papaver bracteatum
MDIIEGDGGVGTVLDVVFQPGAVPQSYKERFETVDHEKRILEVRIIQGGYLEMGCTSYLNRMHVIEITSKSCVIKSSVIYDVKEECADAMSKLITTIQLESMAKVVADYVLKKQSASDTSIPKKQSLMRKEITHEMEVQTSADSIWDIYSSPDIPRLLRDVLLPGAFEKLHVIQGNGGVGTVLDIALPLGAVPRNYKEKFVKINHEKRLKEAVMIEGGYADMGCTFYMHRIHVLEKTPKSCVIESSIVYEVKEEYADKMSKLITTEPLQSMAEAISSYVLKKQFQVFGLEVKPKLVLSLFLCLIIFLAIVGGFLIGGLKA

SEQ ID NO: 1258 - protein, 276 aa, Papaver bracteatum
MIEGGYLDMGCTFYLDRIHVVEKTPSSCVIESSIVYEVKQECAEAISKLITTEPLKSMAEVIANYVLKKQSVSDTNIPKKQSVLRKEITYETEVQTSVDSIWNVYSSPDIPRLLRDVLLPGVFEKLDVIAGNGGVGTVLDIAFPLGAVPRRYKERFVKINHEKRLKEVVMIEGGYLDMGCTFYMDRIHVFDKTPNSCVIESSIIYEVKEEYADKMAKLITTEPLQSMAEVISGYVLKKRLQVFGFEIKPNLRFNLLLCLIICLVIAGGMLIGRVPL

SEQ ID NO: 1259 - protein, 532 aa, Papaver bracteatum
MMRKVIKYDMEVATSADSVWAVYSSPDIPRLLRDVLLPGVFEKLDVIEGNGGVGTVLDIAFPPGAVPRSYKEKFVNIDRVKRLKEVIMIEGGYLDMGCTFYLDRIHVVEKTPSSCVIESSIVYEVEEEYADAMSKLITTEPLKSMAEVISNYVIQKESVSARNIFNRQSVVKKEIRYDLEVPTSADSIWAVYSNPDIPRLLRDVLLPGVFEKLDVIEGNGGVGTVLDIVFPPGAVPRRYKEKFVNINHEKRLKEVIMIEGGYLDMGCTFYLDRIHVVEKTSKSCIIKSSIVYEVKQECAEAISKLITTEPLKSMAQVIANYVLKKQSVSDTNIPKKQSVLRKEITYETEVQTSVDSIWNVYSSPDIPRLLRDVLLPGVFEKLDVIAGNGGVGTVLDIAFPLGAVPRRYKEKFVKINHEKRLKEVIMIEGGYLDMGCTFYMDRIHVLEKTPNSCVIESSIIYEVKEEFADKMAKLITTEPLQSMAEVISAYVLRKRFEVFGLEIKQKLRYNLLLCLIICLVIAGGMLIGRVPL

SEQ ID NO: 1260 - protein, 193 aa, Sanguinaria canadensis
MRKELTHEMEVPASADAIWAVYSSHDIPRLLKEVLLPGVFEKLDVIAGDGGVGTVLDIAFPPGAVPRRYKEKFVKINHEKRLKEVEMIEGGYLDMGCTFYMDRIHVVEKGPNSCVIESAIIYVVKDECADVVVPLITTEPLASMAEVISNYVLRKQIRLFGYVIKPKLGLSILLSLILCLVILGVLLIGGVPF

SEQ ID NO: 1261 - protein, 265 aa, Chelidonium majus
MIEGGYLDMGCTFYMDRIHVVKKGPNSCVIASAIIYEVKEEFVDVVVPLITTEPLASMAEVISNYVLKKQRRVRKELTYEMEVPTSADSIWAVYSSHDIPRLLKEVLLPGVFEKLDVIEGDGGVGTVLDIAFPPGAVPRTYKEKFVKINHEKRLKEVVMIEGGYLDMGCTFYMDRIHVLEKSPNSCVIESSIIYEVKEEFADVVGPLITTEPLASMSEVISNYVLKKQIRMFGYVIKPKLGLSLLLCFILCLVLLGVLLIGGVPL

SEQ ID NO: 1262 - protein, 351 aa, Stylophorum diphyllum
MRKEVRYEMEVPTSADSIWAVYSSHDIPRLLKEVLLPGVFEKLDVIEGDGGVGTVLDIAFPPGAVPRTYKEKFVTINHEKRLKEVIMIEGGYLDMGCTFYMDRIHVLEKGPKSCIIASAIIYEVKEEFADVVVPLITTEPLASMAEVISNYVLKKQRRVRKELTYEMEVPTSADSIWAVYSSHDIPRLLKEVLLPGVFEKLDVIEGDGGVGTVLDIAFPPGAVPRTYKEKFVKINHEKRLKEVVMIEGGYLDMGCTFYMDRIHVLEKGPNSCVIESAIIYEVKEEFADVVVPLITTEPLASMAEVISNYVLKKQIHVFGYVIKPKLGLSLLLCFILCLVLLGVLLIGGVPL

SEQ ID NO: 1263 - protein, 284 aa, Eschscholzia californica
MIGGFLDMGCTFYMDRIHVVAKGPNSCIIKSTLIYEVKEEYADAMASLITVEPLASMAEVVANYVLHQQVRVLGSVKRKELTHELEVAAPADAIWGVYSSPDIPRLLRDVLLPGVFEKLEVIQGNGGVGTVLEIVFHPGAIPRRYKEKFVTINHKKRLKEVVMIGGYLDMGCTLYMDRIHVVSKGPNSCVIKSTLIYEVKAESADAMASTITIDPLASMAQVISNYVLKNQMQVLGSVKRRELTHELEVAASADAIWGVYGSKRYSKASQGCFASWCFRKVRSH

SEQ ID NO: 1264 - protein, 752 aa, Eschscholzia californica
MIGGYLDMGCTLYMDRIHVVEKGPNSCVIKSTLIYEVKAEYADAMASLITVDPLASMAQVISNYVLKNQGQVLGSIKRRELKHELEVAVSADAIWGVIGSKDIPRLLRDVLLPGVFEKLDVIEGDGGVGTVLEIVFPPGAVPRKYREKFVKVDHEKRLKEVIMIGGYLDMGCTFYMDRIHVVAKGPNSCIIKSTLIYEVKEEYADAMASLITVEPLASMAEVVANYVLHQQVRVLGSVKRKELTHELEVAASADAIWGVYSSPDIPRLLRDVLLPGVFEKLEVIQGNGGVGTVLEIVFHPGAIPRRYKEKFVTINHKKRLKEVVMIGGYLDMGCTLYMDRIHVVSKGPNSCVIKSTLIYEVKAESADAMASTITIDPLASMAQVISNYVLKNQMQVLGSVKRRELTHELEVAASADAIWGVYGSKDIPRLLRDVLLPGVFEKLEVIEGDGGVGTVLQIVFPPGAIPRRYKEKFVKVDQKLRLKEVIMIGGYLDMGCTFYMDRIHVVPKGLNSCVIKSTLIYEVKDEYADAMSSLITVEPLASMAEVVSNYVLNKKKLMITRKELTHELEVAASADAIWSVYSSPDIPRLLRDVLLPGVFEKLEVVQGNGGVGTVLEIVFPKGSVPRRYKEKFVKINDEKKLKEVIMIEGGYLDLGCTFYMDKIHVLPKGPNSCVIESSLIYEVKEENAKAMASLITVEPLASMAEVVANYVLKKQIRVLGYVVKPRVGYSVLVGLLLCLVLLGVLLLSGVNI

SEQ ID NO: 1265 - protein, 173 aa, Argemone mexicana
  misc_feature (68)..(68): Xaa can be any naturally occurring amino acid
MRKEVVYELEVPTSADSIWAVYSSPNIPTLLRDVLLPGVFEKLDVIEGNGGVGTVLNIVFPPGAVPRXYKEKFINIDNKKRLKEVIMIEGGYLDMGCTFYMDRIHVIAETPNSCVIKSSIIYDVKKEYAEAMSKLITTIPLKSMSEVIANYVLKNQSVIRKEVTYELQVPTSD

SEQ ID NO: 1266 - protein, 156 aa, Argemone mexicana
MKFELVNELEVPASANDVWAIYSSPDFPKLLTKLVPGILESVEYVEGDGHLGTVIHLVYVPGSVPLSYKEKFVTIDHEKRLKEAVHVEGGFLEMGVTFYMNSFEIIEKGSDCCIIRSMTKCEIEDKEIMNLISHISVANVTVLAMTISKYVQQHKK

SEQ ID NO: 1267 - protein, 215 aa, Thalictrum flavum
MKMEVVFVFFMILGTINCQKLILTGRPFLNRQGIINQVSTVTKGVHHELEVAASADDIWSVYSWPGLAKHLPDLLPGAFEKLEIIGDGGVGTILDMTFTPGEFPHEYKEKFILVDNEHRLKKVQMIEGGYLDLGVTYYMDTIQVIPTGTNSCVIKSSTEYHVKPEFVKIVEPLITTGPLAAMAEAISKLVLEHKYKSNSDEIDASKNNLKMVINM

SEQ ID NO: 1268 - protein, 218 aa, Thalictrum flavum
MKMEATVFVFLMFLGTINCQKLIMAGRPFLHHQGIINQEFTVTKVLHHELEVAASADDIWGVYSSPHLVFHLTDLLPGAFEKVQVIGDGGVGTILDMTFAPGEFPHEYKEKFIVVDNEHRLKKVQMIEGGYLDLGVTYYMDTIQVVPTGTNSCVIKSSTEYHVKPELLKIVEPLITTGPVAAMAEAISKLVLEYKYKSHSDEIHAGLNNNLKMVINNI

SEQ ID NO: 1269 - protein, 193 aa, Thalictrum flavum
MRKELTHEMEVPASADAIWAVYGSPDIPRLLKEVLLPGVFEKLDVIEGDGGVGTVLDIAFPPGAVPRAYKEKFMKVNHEKRLKEVEMIEGGYLDMGCTFYMDRIHVVEKGPNACVIESAIIYEVKDEFADVVVPLITTEPLASMAEVISNYVLKNQFRVFGYVIKPKLGLSLLLCFILCLVLLGGLLIGGVPL

SEQ ID NO: 1270 - protein, 163 aa, Thalictrum flavum
MRKELTNEMEVAASADEIWAVYSSPNLPKLIVQLLPAVFERIYILEGDGGVGTVLYILSPPGSVPRSYKEKFITIDHEKRLKEVQEIEGGYLDMGVTFYMDTFYILEKGPDSCIIKSMTTYEIKDELADKVASLISIDSLVGMAKAITKYVLDQKKAAVDSSA

SEQ ID NO: 1271 - protein, 161 aa, Berberis thunbergii
MVVAASADDVWAIYSSHDLPKLIVKLLPSVFKSIEIVEGDGGLGTVLDVKYPPGSIPLHYREKFITIDNEKRLKEVRQIEDGLLALGCTFYMDSFHILEKDCHHEFFHIHEKNCHKKCIIKSTTVYEVPDELAYKIEPLVTIDSLVGMAHAISKYVLDKSC

SEQ ID NO: 1272 - protein, 486 aa, Corydalis chelanthifolia
MYYFLEFFEKLDVIEGNGGVGTVLDIAFPPGAVPRSYKEKFVKVDHKNRLKEVVMIEGGYLDLGCTFYMDRIHVLPKGANSCVIKSTLIYEIPDELVDSVGSLMSTEPLASMAKVISDYVLKQRKMTANKILRKELKTEMEVATSADSIWAVYGSPDIPRLLRDVLLPGVFEKLDVIEGNGGVGTVLDIAFPPGAVPRTYKEKFVKVDHKNRLKEVVMIEGGYLDLGCTFYMDRIHVLPKGPNTCVIKSTLIYEVPDEFADAVGSLISVEPLASMAEVISGYVLKQKKEAKKILRKELTHELEVPTSADSIWAVYGSPDIPRLLRDVLLPGVFEKLDIVEGNGGVGTVLDIAFPPGAVPRSYKEKFVKVDHDKHLKEVVMIEGGYLDLGCTFYMDRIHVLPKGPNSCVIESSLIYEVREELADVVGSLISIEPLASMAEVISSYVLKQQLRVFGVVVQPRVGLSLLLCLILCLVILGGLLIGGVSI

SEQ ID NO: 1273 - protein, 372 aa, Corydalis chelanthifolia
MRKELRHELEVATSADSIWAVYGSPDIPRLLRDVLLPGVFEKLDVIQGNGGVGTVLDIAFPPGAVPRTYKEKFVKVDHKNRLKEVVMIEGGYLDLGCTFYMDRIHVLPSGPNTCIIKSTLIYEVPDELAYSVASLISVEPLASMAEVISGYVLRQRKMTTNKILRKELTTEMEVPTSADSIWAVYGSPDIPRLLRDVLLPGVFERLDVIEGNGGVGTVLDISFPPGAVPRSYKEKFVKVDHKNRLKEVVMIEGGYLDLGCTFYMDRIHVIPKGPNSCVIKSTLIYEIPGELVDSVGSLMSTEPLASMAAVISDYVLKQRKMTANQILRKELTTEMELATSADSIWSVYGSPDIPRLLRDVLLPGVFERLGCH

SEQ ID NO: 1274 - protein, 199 aa, Corydalis chelanthifolia
MMRKELVHEKEVCASADAVWGVYSSPNIPTLLRDKLLPGMFKRLEILEGDGGVGTILLLEFNNPAIIPHTYLEKFMKLDHEKRLLEVEVVKGGYLDLGCTFYMSRIHILEKGPNSCVIESTLIFEAPEELMEYVSQYANLESLISMAEVISKYVLEQQFRVFGVVVKKLKLGLSTIVLLCIFIFLVIVLGGLWIEGVSI

SEQ ID NO: 1275 - protein, 159 aa, Corydalis chelanthifolia
MRKHLVNELEVVVPADTLWAIYSTTQFPKLIVQLLPIVVQNIEIDGDGSLGTVLNVIFVPGSVPLSYKEKIVTIDHEKRLKEVVQIEGGYLDLGCSFYMSSFQILEKGRDSCIIKSMVTYELAKDADPSVADLVTIAAHAAIAQVISKYVLDKQVAAAP

SEQ ID NO: 1276 - protein, 180 aa, Corydalis chelanthifolia
MRKELTNELEVAAPADAVWAVYSSPDLPKIIVELLPSVFEKIEIVEGDGGVGTVLYVVFPPGSVPLTYKEKFVTIDHEKRLKEVLQIEGGYLDLGCTFYMDSFHILEKDCDSCIIKSITAYEVRDDVVDNVSSLISIDSLANMAEAISKYVLEKQEAATKHGHGDDRERTGLCWPFNCLG

SEQ ID NO: 1277 - protein, 197 aa, Nandina domestica
MRKGIVFLFLVFLGCEVSQGRQLLESRLFRKSTIQKVLHHELPVAASAQEVWDVYSSPELPKHLPEILPGAFEKVVVTGDGGVGTVLEMVFPPGEVPRSYKEKFVLIDDEQLLKKVEMIEGGYLDMGCTFYMDTIQIVPTGPDSCIIKSSTEYYVKPEFADKVVPLISTIPLQAMAEAISNIVLANKAKNKSIIIEI

SEQ ID NO: 1278 - protein, 151 aa, Nandina domestica
MVFPPGEVPRSYKEKFVLIDDEQLLKKVEMIEGGYLNDLDCVHIKRTSHVQISTFNHFDMGCTFYMDTIQIVPTGPDSCIIKSSTEYYVKPEFADKVVPLISTIPLQAMAEAISNIVLDKTKDQRNKEVINTNTKNNKIHHRYVATIVIIR

SEQ ID NO: 1279 - protein, 196 aa, Nandina domestica
MRSGIVFLVLFFLGCEISQGRQLLESRLFRKSTIRKVLHHELPVAASAQEVWDVYSSPELPKHLPEILPGAFKKVVVTGDGGVGTVIEMVFPPGVVPHRYKEKFVLIDDEKFLKKVEMIEGGYLDMGCTFYMDTIQIVPTGPDSCIIKSSTEYYVKPEFADKVVPLISTVPLQAMAEAIAKIVLEFKAKHKGFIEI

SEQ ID NO: 1280 - protein, 148 aa, Nandina domestica
MEVAASAGDIWAVYSSPDLPRLIVQLLPTVFEKIDIVEGDGGVGTVLHITFPPGSVPLTYKEKFVTIDNANRLKEVLQIEGGYLELGCTFYMDSFQIFEKGIDSCIIKSMTTYEVPDELADKVAPLISIDSLVPMAEAISKYVIEKRH

SEQ ID NO: 1281 - protein, 154 aa, Cocculus trilobus
MIKKELKHEMRVAASADDIWAVYSSPDLPNLILRLLPSVFDNIEIVEGNGGVGTVLHLTFPPGSVPLSYKEKFVTINGNKRLKEVKQIQGGYLDMGCTFYMDSFHIEEKGCDSCVIVSKTEYEVPNEEIANQVELYISIDSLASMAQGHLGLCS

SEQ ID NO: 1282 - protein, 205 aa, Hydrastis canadensis
MKMAILFVFLMFLGKMNSEGLHLSGRPLLRAIISDKPNVIKVLKHELAVPASADKVWAVYSAPTLAFHLSDLLPGAFEKVEVFGDGGVGTIIDMTFAPGEFPHEYKEKFILIDGKQRLKKVQMIEGGYLDLGVTYYMDTIHVVPTGSNSCIIKSSTEYHVKPEAAKLVEPLITTEPLAAMAEVITKIVLENKSKSSEENQSSEAI

SEQ ID NO: 1283 - protein, 229 aa, Nigella sativa
MVQFSRESKQISIISDEEEGGEEETKEKKMMKVQVALAFLLILGAASCQELILQGRPLLGGARAWGTKSIKKELKHEFKVAASADEVWSVYSAPELCKHLTDLLPGAFEDVEIIGDGGVGTILHMIFPPGEFPHEYKEKFVVIDDKQRLKKVEMIEGGYLDIGVTYYMDTIHVVPTGSDSCVIKSSTEYHVKPEFEKIVEPLITTVPLAAMAEAIAKIVLDNKTHSITI

SEQ ID NO: 1284 - protein, 199 aa, Nigella sativa
MVKIQLVLACLLLVVGAVNCQKLILQGRPLLGAWACGTIKKVLKHEFKVAASADEVWSVYSSPELCKHLTDLLPGAFQDLEIIGDGGVGTILHMTFPPGEFPHEYKEKFVLIDDKRKLKKVEMIKGGYLDIGVTYYMDTIHVVPTGSDSCVIKSSTEYHVRPECEKIVEPLITTEPLAAMAEAVSKIVLDAKIHSIITI

SEQ ID NO: 1285 - protein, 311 aa, Menispermum canadense
MIKKELKHELEVATSADEIWEVYSSPDLPILIVKLLPSVFEKIEILEGDGGVGTALRLTFPIGSVPLTYKEKFVTINDWKRLKEVKQIEGGYLDMGCTFYMDSFHILRKGPKSCVIVSKTEYEVPNKEIASKVEPYISIDSLRKMATAISDYVLNRATRKEVKHELEVAASADDVWEGYRSPDVGSLICPHVFEKIELVEGDGGVGTILQITHPPGYVPHTYKEKYVTLDDHKRLLEVEQIEGGYLEMGCTFYMDSIHVVKKGDNSCVIVSKAKYEVPKELASQVEPYIAADAVANMARIISNNVLEKKKS

SEQ ID NO: 1286 - protein, 195 aa, Xanthoriza simplicissima
MRMEVVLVVFLLFIGTVNCERMIFSGRPLLHRVTNEETVILYHELEVPASVDELWSVEGSPELGKNLPDLLPGIFADFKITGDGGEGSILDMTFPPGQFPHHYREKFVFFDHKNHYKLVQMIDGDFFDLGVTYYMDTIRVVATGPDSCVIKSSTEYHVKVEFAKIVKPLIDTVPLAIMSEAIAKVVLEKKYKRSE

SEQ ID NO: 1287 - protein, 368 aa, Argemone mexicana
MCLFFAEKMGLMAEANNQQQLKKEDLLKNMELGLIPDEEIRKLIRVQLEKRLNWGYKSTHEQQLSQLLHLVHSLKKMKIATEMENLDLKLYEAPFSFVQIQHGSTIKESSGLFKDESTTLDEAEIAMLDLYTKRAKIEDGQSVLDLGCGLGAVTLYVAQKFKNCYVTGITSSVEQKDFIEGRCKELKLSNVKVILADITTYETEEKYNRIFAVELIEHMKNYELLLRKISEWMKQDGLLFIEHVCHKTLAYHYEPLDEEDWYTNYIFPAGTLTLSSATLLLYFQDDVAVVDQWTLSGKHYSRSHEEWLKRIDGNIEEVKEIMKSITKSEEEAKKLLNFWRIFCMCGAELFGYKNGEEWMMTHILFKKK

SEQ ID NO: 1288 - protein, 361 aa, Argemone mexicana
MDNCKVEGMKKETRAAEEILGRLLKGEIKDEELRKLIKFQFQKRLEWGYKSTHHQQLSFNLDFIKSLKNMDMSGEIETMNKETYELPTEFLEAAFGKTMKQSGCYFKHESTTIDEAEEASHELYCERAQIKDGQTVLDIGCGQGGLVLYIAEKYKKCHVTGLTNSKAQVNYIEMQAKKLGLSNVDVILADVTKYDSDKTYDRLLMIEAIEHMKNIQLFMKKLSTWMTKDSLLFVDHICHKTFSHPFEAVDEDDWYSGFIFPPGCVTILSSDALLYFQDDVSVVDHWVINGMHMARSVEWRKKLDKNMKAAKEILLPGLGGNHEAVNQIVTHIRTFCMGGYEQFSYNNGEEWMVAQMLFKKK

SEQ ID NO: 1289 - protein, 357 aa, Argemone mexicana
MALKKIMEMPYAATVRVMLASLERNLLPDAVIRQLTRLLLSTRLRLGYAPSAHLQLAQLLQFAHSLRDMPIAIKTEDPKVQHYELPTSFFKFVLGENLKYSCCYFNDTSSTLDDAEKAMLETYCERSGLEDGHTVLDVGCGWGSLSIFIAKKYSKCKITGICNSTTQKAFIEERCRDLDLHNVEIIVADISMFDMEASYDRIFSIEMFEHMKNYKELLKMISRWMKPDSLLFVHHFCHKTFAYHFEDINEDDWITRYFFSGGTMPSANLLLYFQDDVSVVNHWLVNGKHYAQTSEEWLKRMDKNMSSVRPIMESTYGKDSSVKWTVYWRTFFIAVAELFGYSNGEEWMVAHFLFKRK

SEQ ID NO: 1290 - protein, 357 aa, Berberis thunbergii
MEVKQAGKEGVTELLVKRMELGLVPEEEIRRLMRIQIQKRLDWGYKPTHEEQLAHLTKFIQNIRGMKMADEIDALDAKMYEIPLPFLQTICGKTLKFSPGYFKDESTTLDESETLMMDLYCERAQVKDGQSILDLGCGHGGFVLHLAQKYRNSVVTGVTNSVSETEYIKEQCKKLGLSNVEIIIADVTKFEPEVTYDRVFAIALIEHMKNYALVLNKISKWVAQDGYLFVEHHCHKVFPYKYEPLDEDDWYTNYIFPGGTLILPSASILLYFQEDVTVLNHWSLSGKHPSRGFIEWLKRLDENIDVIMGIFEPFYGSKEEATKWINYWRVFCMTHSEMYAYGNGEEWMLSQVLLKRK

SEQ ID NO: 1291 - protein, 356 aa, Berberis thunbergii
MDSKQAKKASVVELLERLEEGLVSDEELKKLVHVQLEKRLQWGYKPTHQEQLAFHLDFIKSLKQMDIAGDMEMMNSESYELPISFLKTMFGKTLKQSACYFESESVTIDEAEIAMNALHCERARLKDGQRILDIGCGQGSLIFHIANKYKNCLLTGITNSCTQKTYIEEQCKNLKLSNIKVILADVTKYETEDKFDRIVIIEALEHMKNIELFLKRTSKWMKEDGLLFVDHVCHKVFPDKFEELDEEDWYSEYIFPKGSVIVNAASTLLYFQDDVSVIDHWIINGKNMARSHEEWMKNLVKNVDVAKDILKVAMGSEEAAERCIIHCRNFHLSMSELFSYQNGEEWMVSHVLFKKR

SEQ ID NO: 1292 - protein, 360 aa, Berberis thunbergii
MGGALIEVSGQKLSKAELLKNIEEGLIPDDELRRLMRGELAKRIQWGYKPTHEQQVAQAINFAHSLRKMKIANEAETLVEEVYEMPMSFLRLMLGPTLKLSCLYFKNEFTTLEQAEIDTMDMYCKRAGIQDGMSILDLGCGQGSLTLHIAHKYKNCRITALTNSASQKGNIEDQCKLQNLPNVKVILADIANFDMDETFDRVMVIELFEHMKNYALLLKKMAKWMSSDGLLFVDTLCQKTFPYHFDPIDEDDWYTNLLFTPGTSILPSASFLLYFQDDVSIANHWTISGKHFSRTNEEWLKRIDGQVNEIRAVLKSFLGTEKGVEKLINYWRGFCLSGMEMFGYDNGEEWMTAHYLFRKK

SEQ ID NO: 1293 - protein, 366 aa, Corydalis chelanthifolia
MATSDQEVKTSKMEMIADLLKRLEAGLVPDDEIRSLIRVELERRLKWGYKSTHQEQLDQLLNLAHSIKKMKIASTEMDGLTSTMYEVPISLVQIQLGSHLKESCLYFKDETTTVDEAEIAMMDLYLERAQIKDGQSILDLGCGLGAVSFHIAQKYTSCNITAVTNSVRQKEFIEEKSKTLNVPNVKVLLADITTLEMEHTFDRLFAISLIEHMENYELLLRKLSEWMKQDGLLFIEHLCHKTLSYHFEPMDEDDWYTNLLFPAGTLTLVSASFLLYFQDDLSVVNQWVMSGKHFSRANEEWLKNMDAKMDEMREIFESITDSEEEVVKLINHWRIFCISSAEMFAYNDGEEWMNSHVLFKKKKQIQ

SEQ ID NO: 1294 - protein, 359 aa, Corydalis chelanthifolia
MAGSGANKEMIADLLKRLEVGLVPDEEIRSLIRFQLKRRLKWGYKTTHQEQLEQLLSLAHSIRKMKIATEMDALNSTMYEVPISFMQIVFGSTLKESCLYFKDEATTVNEAEIAMMDLYLERAQIKDGQSILDLGCGMGSLCFHIARKYTNCNITAVTNSVSQKEFIEEKSKTLNLPNVKVILADITTLEMDDTYDCLFAIGLIEHMKNYELLLRKLSNWMKQDSLLFIDHVCHKTLAYHYEPIDEDDWYTNLLFPAGTLTLVSASFLLYFQDDLSLVDHWSMSGKHFSRTNKEWLKNIDGKMDKIREIVKSITDSEEEVVKLINHWRMLCINSSEMFGFNDGEEWMNSHVLFKKKKQI

SEQ ID NO: 1295 - protein, 371 aa, Corydalis chelanthifolia
MIKKSKIMAFSDHHHEVVKNHSKKEMIADLLKRLEAGLVPDEEMRNLFRFELERRLQWGYKSIHQEQLSQLLKLAHSTKEMTIVAEMDALNSSMYELPISFLQIQLGSNLKQSSLYFKDELTTVDEAEVAIMDLYLERAQIEDGQSILDLGCGLGAFSFHVARKYTNCNITAVTNSLTQKEFIEKKSKILNIQNVKVIFADVTTVEMETTFDRVFAIGLIEHMQNYELFLKKLSKWMKQDGLLFIEHFCHKTLAYHYKPIDEDDWFTNLLYPNGTVISSSLLLYFQDDVSVVDHWSLSGKHFSRASEESLKRMDAKMDEMKEIFESITDSKEEAMKLINQWRIFCISCAEMFGYNNGEEWMTSHFLFKKKL

SEQ ID NO: 1296 - protein, 366 aa, Corydalis chelanthifolia
MAVEEGGIGATTEISTKKPEIAELLRKLELGLIPDEEIRRLIRIELGRRLKWGYKPTYEQQLAEVQKLAHSLRDMNIAKEIDTLDEQMYEVPISFLQIMFGSTIKGSCCYFKEDSMTLDEAEIAMLDLYCERAQIKDGDSVLDLGCGQGALTLHVAKKFKNSRVTAITNSVSQKEFIEEQARNLNLTNVTVTLADITKHEMEDRFDRILVIELFEHMKNYELLLRKISNWMTKDGFLFIEHLCHKTFAYNYEPIDEDDWYTEYIFPAGTMIIPSASFFLYFQDDLTIANHWTLSGKHFSRTKEEWLKRLDANKDAVMAIMEEFSGSKEDAVKWTNYWRGFCFSGMEMYGYNNGEEWMACHVLFKKD

SEQ ID NO: 1297 - protein, 363 aa, Corydalis chelanthifolia
MEVVATSSARNPKKEIVDLWKRMELGLIPDEEIRDLMKIGLEKRLKWGYKPTHEQQLSQLLHFAKSLRSMKMASEMETLDDQMYETPTAFQQLMCGSTIKESAGFFKDESTTLDEAEIKMLDLYCEKARIEDGQKILDLGCGHGAVMLHIAQKYKNCNVTGVTNSISQQQFIVQRSKELNLSNVNMILADVTMLEMDATYDRIFIIGLIEHMKNFELFLRKISKWITKEGLLFLEHYCHKTFAYQCEPVDEDDWYNMFIFPPGTLILPSASFLLYFQDDLIVVDRWTLNGNHYARTQEEWLKRIDANVDGVKQMFESVCDGNKEEAVKLMNFWRIFCISGAEMLAYNNGEEWMISHYLFKKRN

SEQ ID NO: 1298 - protein, 373 aa, Corydalis chelanthifolia
MGSSTASDHEMVIMENDSKNKQVVIADLLKRLVGGLVPDEEMRNMFRFELEKRLKWGYKSTHQQQLSQLLNLVELNKGIAKIAPEMDALNSAMYEVPIPYLKLMLGSTLKQSCLYFKDESTTLDEAEIEMMDLYLERADIQDGQSILDLGCGLGGLGFHIAQKYISCNITALTNSLTQKEFIEEKCKTLNIPNVKVILADVTTVEIETTFDRLFAIGLVEHMENYELFLRKLSKWMKQDGLLFIEHLCHKTLAYHYKPIDEDDWYSNLLYPTGTLTSASFLLYFQDDLSVVDHWSLSGKHFSRATEEWLKMIDANMDKIREIYESVTESKEEATRSINQWRIFCISCAEMFGYNDGEEWMISHFLFKNKKQIE

SEQ ID NO: 1299 - protein, 350 aa, Corydalis chelanthifolia
MGINFLERLGKREVSDEELKKQIRIIWEKRLQWGYRSTHEDQLKSNLDFVKSLKEMKMSGDIDTFNNESYELPSEFLESMFGKTIKQSACYFKHESMTIDEAEDASHELYCERAQIKDGQTVLDIGCGHGGLVLYIAQKYKNCHVTGLTNSRAQVNYIEMQSKKLNLTNVEAILADVTKHEFKTEKTFDRIILIEAIEHMKNIELFMKKLSTWMTEESLLFVDHICHKTFNHHFEAMDEEDWYSGYIFPKGCVTILSSSALLYFQSDVSVVDHWVVNGNHMARSVQEWLKKLDDNMETVRGILEPAMGGSKEAVDQVITHSRTFCMGAYEQFSFNNGEEWMVAQILFKKK

SEQ ID NO: 1300 - protein, 353 aa, Corydalis chelanthifolia
MAVVNILERFRKREIGDEEFKQHIRSIWVKRLQWGYRSTHEEQLNSNLDFIKSLKKMDMSGDIDKYNTQEYELPSEFQQIIFGKSIKQSGCYFKEESKTKTLDEATDDSHELYCERAQIKDGQTVLDIGCGNGGLVLYIAQKYKNCHVTGLTNSKAQVKHIELQTKKLNLTNVEVILADVTKHVFKTEKTFDRIILIQVIEHMKNIELFMRKLSTWMTEESLLFVDHICHKTFNYHFEPMDENDWYSGHIFPEGCVTILSSSSLLYFQKDVSVLDHWVVNGKHMARSAQEWLKSLDDNMEKVREILEPSMGGNKEAVDQVLTQSRFFCMGAYEQFSNNNGEEWMFAQLLFKKK

SEQ ID NO: 1301 - protein, 371 aa, Corydalis chelanthifolia
MEMEKGSSSGVKILERLKKGEISDEELKKHIRVHWEKRLQWGYKPTFQEQLQSNLDFVKSLKEMEMSGEVEIPLNIGESDEVSNYQKKRKSYELSSEYLGAMFGKTLKQSACYFKDESMTLDEAEEAAYELYCERAQIKDGQTVIDIGCGHGGLVLYIAQKYKTCHVTGLTNSKTHVNYIEMQCKKLQLSNVDVILADVTKYDTEKTFDRIVVVGTIEHMKNIGLFMKKLSTWMKKEGLLFVDHTCHTSFNYHFEAMDEDDWYSGYIFPKGSVTFLSSSALLYFQEDVSVVDHWLLSGMHMARSMQEWMKKIEQNMDTLRSLLEQTMEGGSNEAVNQVVTHLRTFCIGAYETFSYNNGEELMMAQFLFKKK

SEQ ID NO: 1302 - protein, 362 aa, Corydalis chelanthifolia
MAGEKREMERLFQLPYDATVRMMLNALERNLLPDLVIRKLTRLLLGSRLRWGYKSISDLQLSHLLQFAHSLEEMPIAIKTDAAKTQHYELPTSFFKLVLGKNMKYSCCQFDKSNTTLEDAEIAMLELYCERAQIKDGHTVLDIGCGWGSLSLFIAKKYSKCKITGICNSTTQKTHIQDQCRDMNLQNVEIIVADISTFDMESTYDRLVSIEMFEHMKNYKELLKKISKWMKQDSLFFVHHFCHKTFAYHFEDTNEDDWITRYFFTGGTMPSANLLLYFQEDVSVVNHWLVNGKHYALTSEEWLKRMDKNLDSIKPIMESTYGKDSAVKWTVYWRTFFISVAELFGYNNGDEWMVAHLLFKKK

SEQ ID NO: 1303 - protein, 357 aa, Chelidonium majus
MGSIDEVKKESAGETLGRLLKGEIKDEELKKLIKFQFEKRLQWGYKSSHQEQLSFNLDFIKSLKKMEMSGEIETMNKETYELPSEFLEAVFGKTVKQSMCYFKHESATIDEAEEAAHELYCERAQIKDGQTVLDIGCGQGGLVLYIAQKYKNCHVTGLTNSKAQVNYLLKQAEKLGLTNVDAILADVTQYESDKTYDRLLMIEAIEHMKNLQLFMKKLSTWMTKESLLFVDHICHKTFAHFFEAVDEDDWYSGFIFPPGCATILAANSLLYFQDDVSVVDHWVVNGMHMARSVDIWRKADKNMEAAKEILLPGLGGSHEAVNGVVTHIRTFCMGGYEQFSMNNGDEWMVAQLLFKKK

SEQ ID NO: 1304 - protein, 367 aa, Chelidonium majus
MEDQQTLLCVFLCKLKKMQLMAKEELLQNMELGLIPDQEIRQLIRVELEKRLQWGYKETHEEQLSQLLDLVHSLKGMKMATEMENLDLKLYEAPMEFLKIQHGSNMKQSAGYYTDESTTLDEAEIAMLDLYMERAQIKDGQSVLDLGCGLGAVALFGANKFKKCQFTGVTSSVEQKDYIQGKCKELKLTNVKVLLADITTYETEERFDRIFAVELIEHMKNYQLLLKKISEWMKDDGLLFVEHVCHKTLAYHYEPVDAEDWYTNYVFPAGTLTLSSASMLLYFQDDVAVVNQWTLSGHYSRSHEEWLKNMDKNIVEFKEIMRSITKTEEEANRLLNFWRIFCMCGAELFGYKNGEEWMLTHLLFKKK

SEQ ID NO: 1305 - protein, 360 aa, Chelidonium majus
MGVEITESSNAKKAEVAELLRKLELGLLPYDEIRRLMRIELGRRLQWGYKPTYEEQLAQVVKLARSLRSMNIATEIDTLDEQMYEVPIPFLQLMFGSTIKGSCCYFKDESTTLDEAEIAMLDLYCERAQIQDGQSVLDLGCGQGALTLHVANKYKNCRVTAVTNSVSQKEFIEEKSRKLNLKNVEVMLADITTHEMEDTFDRILVIELFEHMKNYELLLRKISKWMSNDGLLFIEHICHKTFAYHYEPIDEDDWYTEYIFPAGTMIIPSASFFLYFQDDLSVVNQWTLSGKHFARTKEQWLKRLDANVDEVMKIMESFSGTKEGAVKWTNYWRGFCLSGMEMYGYNNGEEWMASHVLFKK

SEQ ID NO: 1306 - protein, 353 aa, Chelidonium majus
MASGKVVDLLKRLDSGLVSDEELRRVIRFELERRLKWGYKPTHEQQLAELLNLAHATKQMEIATKIDTLNSTMYEVPNSFLEIQLGSTLKESCLYFKDESTTVDEAEIAMMDLYLERAQIKDGQIILDLGCGLGALAFHIAQKYTNCNVTSVTNSVKQKEFIEEKCKILNVSNVKVILTDICTLEMEATFDRIFAIGLIEHMKNYELLLRKFSAWMKQDGLLFIEHLCHKTLGYHNEPIDEDDWYTAYFFPAGTLTFIPSSFLLYFQDDVSVVNHWTLSGKHFSRSNEEWLKRMDNKIDEVKEIYKAAASETKDDDIMKLIRLWRFLSISAAEMFGYKDGEEWMISQVLFKKK

SEQ ID NO: 1307 - protein, 368 aa, Chelidonium majus
METGKNNQNMKTTIDDLWNQMMLGIVPDKEIRRLMKIELKKRLDWGYRPTHQQQLSQLLDFAKGLCNYCWTALRCMKMSAEFDTLDSKVYETPKSFQQIMCGTTIKESSGLFMNESTTLDQAQISMLDLYFDKAKIKDGQSILDLGCGHGALILYLAQKYQNCNITGVTNSLSQKEFIVEKCKKLGLSNVEILLADVTKLEMEDMFDRVFVIGLIEHMKNFELFLRKISEWMKPDGLLFLEHYCHKSFAHQWEPIDEEDWFSKYIFPPGTVIIPSASFLLYFQEDVKVIDHWTLSGNHFARTQEEWLKGIDGHIDEVEKTFESFYGISKEEAVKLINFWRVFCLSGVEMFGYNNGEEWMISHLLFKKK

SEQ ID NO: 1308 - protein, 360 aa, Chelidonium majus
MGSSEAPSVIGSSKAGEIMGRLMKGEIGDEELSKLVRHQWERRLQWGYKPTHEQQLACNFDFIKSLKDMDMSGEIDTMNEETYELPSAFLEATFGKTIKQSGCYFKDETTTLDEAEEASHELYCERAQIKDGQTILDIGCGQGGLVLYIAQKYKNCHVTGLTNSKAQMNYILMQAKKLQLSNVDVISADVTKFDNDKTYDRILVIEAIEHMKNIQLFLKKLSTWMKKDSLLFVDHISHKKFNHHFEALDEEDWYSGFIFPKGCVTILSSSTLLYFQDDVSVVDHWVVNGMHMARSMEEWRKKLDKNMEAAREILEPGLGSKEAVNQVITHIRTFCLGGYEQFSFNNGEEWMITQMLFKKK

SEQ ID NO: 1309 - protein, 356 aa, Cissampelos mucronata
VDPVEQKNDKKAELLRKLELGQVPYDEIKRLIKVELDRRIQWGYKPTFEQQTADVLSFAHSLRKLNIATAVDTLDSEMYEVPISFLKIMFGNTIKGSCCYFKDDSVTLDEAEIAMLDLYCERSQIKDGQRVLDLGCGQGALTMHVARKFRNCHVTGITNSVSQKEYIEEQCKINNLMNVEIKLADITTHEMEDRYDRILVIELIEHMKNYELLLRKISEWLTPDGLLFIEHICHKTFPYHYEPLDEDDWFTEYIFPAGTMIIPSANFLLYFQDDVTVVNHWTLSGKHYSRTHESWLKNIDANAEAVKKIMVSFTGSEDAALKQMNYWRGFNLSGMELYKYRNGEEWMASHVLFKKK

SEQ ID NO: 1310 - protein, 368 aa, Cissampelos mucronata
MAAGGGEEFGDRVEQKLNKKGEVAELLRKLELGELPDDEIRRLIKLQLDRRIRWGYKPSHEQQVAYLLDFANSLRKLNIATAVDALDSEMYEVPIPFFKFMFGSTVKASCCYFKDDFVTLDEAAIAMLDLYCERSQIEDGQRVLDVGCGVGALTMHVARKYKNCHVTGVTNSVAQKDYIEEQCKINSLTNVEIKLVDISSHEMEEKYDRILAIAFIEHMKNYELLLRKISKWLAPEGLLFIDHVCQKTFPYHYEPIDEEDWYTEYIFPAGTMIIPSANLLLYFQDDVTITNHWVLSGKHFSRTHEMWLKNLYANAKAMKEIMVSFTGSEEAAAKQMNYWRGFALSGMELFGYENGEEWMASHLLFKKK

SEQ ID NO: 1311 - protein, 365 aa, Cissampelos mucronata
MANMGGFNGEAPSLSNRGEVAELLRKLGLGLIPDEEIRNLMRVQVQRRLQWGYKPTFEQQLAQVVHFAHSLKQMPISLEAEAMESQVYEIPNSFMKLLHGSSMKASWCYFINDSTTLDEAEIAMLELYCERSQIRDGDRVLDLGCGFGALSTYIARKYPNCQVTGVTNSTFQKEFIEDQCKKDNLVNVEVILADVTTHEMDREFDRIMAIGVIEHMKNYKLLLRKISKWMKQDGLLFVDHICHKAFAYHFEPLGAEDWIEEYIFPGGVMTIPSANLLLYFQDDVYVVNHWMVNGKHYSRTNEEWLKRLDGNANVARAILEGSIGSKEEAMKMLNYWRTFCLYGIELCKFNNGEEWMSSHVLFKKK

SEQ ID NO: 1312 - protein, 359 aa, Cissampelos mucronata
MEVKQSKGDELRSRVAELLERPELGLVPDEEIRRLAKARLEKRLKWGYKATHGEQLSSLLQFVESLPSLNMASEDDSPKAWLYETPTSFLQLIYGDIIKESGSYYKDESTTLEEAMIHNMNLCCERANIKEGQSVVDLGCGYGAFILHVAQKYKTCRVTGITSSISQKHYIMEQCKKLNLSNVEVILADVATIKLDATFDRVFAAGMFEHVNDYKSFLRKITNWMKPDGRLFVEHLCNKTFPYQNKPLDDGDNWGEYVFPSGGLIIPSASLLLYFQEDVSIVNHWTFSGKHAANKFEELLKRIDAKIDAIKRIFNECYGSKDSIRFINYWRVFLITAAEMFGYNNGEEWMGVHLLFKKK

SEQ ID NO: 1313 - protein, 364 aa, Cissampelos mucronata
MEAKQHESNNNIDEELKNRVNIGEQEERPGFEDEEIRRLAKAQLAKRLKWGYKPTHEQQLSHLLQFLQSLPSLNMASEDESSKAWLYETPTSFLQLLFGNVIKFSGYYYKHESSTFEESMIHNMDLCCERANIKEGQNVIDLGCGYGAFVLHVAQKYKSCSVTGITCSITQKHHIMEECKKLNLCNVKVILADVATIELGTAFDRVFAFGMFEEINDYKLILRKISNWMKPDGLFFVEHLCHKTLAYQNKLIDDQDWYEEYIFPSGGLIVPSASLLLYFQDDLSVVYHWTYNGKHGARSFEKMLERTDANIDTIKDMFTEFYGSKEKAIKFINYWRVFFITAAEMFAYNDGEEWMCSQLLFKKK

SEQ ID NO: 1314 - protein, 354 aa, Cissampelos mucronata
MTSEALKATKAEVLEKLGLGLIPDEEAKRLIRDQLERRVQWINTHDCEQRLAHLHNYVQSLRQADLDTTNGFNPDTYEMPIAFMKLIQGRLMKLSTCYFKNKSTTLEDAEEEMLDLYCERAQIRDGDQILDLGSGYGSLAIYVARKYPHCHVTAITNVKSQTKFVKEQCKNYKLNNVEVVLGDITKVELNKEFDRVMAIEVFEHIKNYELLLKKISKWMKKDGLLFVENMCHKNHSYQMKPLHEDDWIEEIIFPDEIVTIASADLLLYFQKNVSIANHWVLNGKHISRSSEAWLNRLDDNANAAKAVLKDFLGSEDEAVKWINQFRLSFIHGIMQGEFNNGEEWMIAHFLFKKK

SEQ ID NO: 1315 - protein, 354 aa, Cissampelos mucronata
MEALFQVPYNVTVKMLLGSLERALLPDMVVRRLTRLLLAARLRQGYKPSSQLQLSDLLHFAQSLQDMPIAIRTDKPKEQHYELPTSFFKLVLGKNMKYSCCYFLDKSSSLEDAENAILELYCERAHLKDGHTVLDVGCGWGSLSLYIAQKYPNCRVTGICNSTTQKACIEERCRELQVNNVEIIVADISTLEMEGTFDRVFSIEMFEHMKNYKELLKKISKWMTQEGLLFVHYFCHKTFAYHFEDLSDDDWITRYFFTGGTMPSANLLLYFQEDVSILNHWLVNGKHYAQTSEEWLKRMDNLASIKPIMESTYGKAEAVKWTVYWRTFFIAVAELFGYNNGEEWMVAHFLFKKK

SEQ ID NO: 1316 - protein, 364 aa, Cissampelos mucronata
MEHKIEDIRKLKSRVEEQLERPELGLVKDEDIKTLAKAKLEKRLKWGYKPTYAEQLSNLLQFAQSLPSLKMENVDDQGSSKQWLYGVPSEFLQIIYGGIIKMSGSYYEDESTTLEESMIKDMDSCCEKANVKEGHSVLDIGCGYGSLIIHIAKKYRTCNVTGITNFVEQKQYIMEECKKLNLSNVEVIVGDGTTINLNTTTFDRVFVTGMLEEINDYKLFLKSVSDWMKPDGLLLVTHFCHKTFAYQNNKALDDEDWHNEYIFPSGNLIVPSASLLLYFQEDLSVVSHWATNGTHTGRTCKKLVERIDANIEKIKEIFSEFYGSKEDAIRMINYWRVLCITGAEMYTCKDGEEWMDVYYLFKKK

SEQ ID NO: 1317 - protein, 275 aa, Cissampelos mucronata
SEFLEAVFGKTVKQSMCYFKHESATIDEAEEAAHELYCERAQIKDGQTVLDIGCGQGGLVLYIAQKYKNCHVTGLTNSKAQVNYLLKQAEKLGLTNVDAILADVTQYESDKTYDRLLMIEAIEHMKNLQLFMKKLSTWMTKESLLFVDHICHKTFAHFFEAVDEDDWYSGFIFPPGCATILAANSLLYFQDDVSVVDHWVVNGMHMARSVDIWRKALDKNMEAAKEILLPGLGGSHEAVNGVVTHIRTFCMGGYEQFSMNNGDEWMVAQLLFKKK

SEQ ID NO: 1318 - protein, 367 aa, Cocculus trilobus
MAVGAGDNRDLVEPKNDKKEEVAELLRKLELGHVPDDEIKRLIKVELDRRIQWGYKPTYEQQTADVVNFAHSLRKMSIATEMDTLDSEMYEVPISFFKLMFGSTIKASCCYFKDDSTTLDEAEIAMLDLYCERSQIKDGQRLLDLGCGQGALTMHVGRKYKNCRVTGVTNSVSQKEYIEEQCKINNLTNVDVILADITTHVMDDRYDRILVIGLFEHMKNYELLLRKMSEWMTPEGLLFIEHACHKTFAYHYEPLDEDDWFTEYIFPSGTMIIPSANFLLYFQDDVALVNHWTLSGKHYSHTHEWWLKNIDANAEAVKKIMESFTGSEEAAVKQLNYWRGFNLSGMELFKYRNGEEWMASHVLFKKK

SEQ ID NO: 1319 - protein, 352 aa, Cocculus trilobus
GLKSSVAELLERPELGLVPDGEIRKLTKTRLAKRLEWGYKATHEDQLSHLLRFIHSLPSLNMASEDDSPKAWLYETPTSFLQLIYGDIIKESGTYYKDESSTLEEAIIHNMDLCCERARIKEGQSVLDLGCGYGAFTLHVAQKYKSCSVTGITSSISQKDYIMEQCKKLNLSNVEVILADVATIKMNTTFDRVFALGMFEHINDYKLFLRRISNWMKHDGLLFVEHLCNKTFAYQNKPLDDGDDWFNEYVFPSAGLIIPSASLLLYFQEDVSIVHHWTFSGKHAAYKFEELLERIDAKIEAIKEIFIECYGSKEDAIRFINYWRVFLITAAEMFAYRDGEEWMGSHVLFKKK

SEQ ID NO: 1320 - protein, 353 aa, Eschscholzia californica
MVDLKVEKEELLKSMELGLVPDEDIRKHIRSQLEKRLKWGYKPNHEQQLAQLLDVIHSLKKMKISKEYESFDLRLYEAPFDFHKIQLGTHLKESCSYYKDESTTLDEAEGAMLDLYTQKAKIEDGQSILDLGCGVGAVTLFVANKYKNCKVTGITSCQWQKDFIENKCKELNLTNVRVIIGDVTAYEMEETFDRIFAIELIEHMKNYELLLRKISKWMKDDGLLFIEHVCHKILAYPYEPIDEEDWFTEYIFPGGTLTLSSASLLLYFQDDVSVVEHSSLNGKHYSRSHGEWLKNIDANIDEVKGIMRSITKTEEEAVRLVNFWRIFCMCGIELFGYNNGEEWMVSHILLKKK

SEQ ID NO: 1321 - protein, 359 aa, Eschscholzia californica
MAADLVVKKWNNKKELIDEMELGLVGDEEIRELIRNDLEKRLKWGYKSNHEQQLAQLLHFVHSLRGMKIAADEVESFNIKVYEAPFSFNKIQLGSSLKESSCYYKHDETTLDEGEIAMMELYTEKAQIKDGQSVLDLGCGLGSLTLYVANKYPNCKVTGTTASLWHKDFIESKCKEQELTNVKIVLGDATTHEMEERFDRILAIGLIEHLKNYGLLLGRISKWLKDDGFLFIQHVCHKTLAYPLVPVDEEDWIGEYIFPGGTLTMPSASLLLYFQDELSVVDHSTLNGKHFSRTHEEWLKNIDAKIDEVKEILKSVTKTEEEVVRLTNFWRIFCMFGVEMFGYNEGEEWMLSQILFKKK

SEQ ID NO: 1322 - protein, 366 aa, Eschscholzia californica
MASLVEEGSFVNNKESVKERVSELVKRLKNGLVSDEELRKLMRVELEKRLEWGYKSTHEQQLSQLIDLAHSMKKMEIAMEIDALNSTVYEVPLSFLQIIHGTTIKESCLYFKDESTTVDEAEIAMMDLYLERAQIKDGQSILDLGCGLGGFSFHIASKFTGCNITAVTNSVKQKEFIEEKCKTLNVPNIKVILADICTTEIENVFDRIIAIGLIEHMKNYELLLKKFSKWMTQDGLLFIEHLCHKTFGYHNEPLDEDDWYTTYFFPAGTLTFIPSSFLLYFQDDVSVVDHWTLNGKHFARSNEEWLKRMDEKMDEVKQIFRSNLKSENEVTKTIGEWRFLSMSAAEMFGYNNGEEWMVSQLLFKKK

SEQ ID NO: 1323 - protein, 364 aa, Eschscholzia californica
MALEQEDSMSVPERNEGVADLIKRMELGLVNDEEIRRLMRIQIENRLKWGYKPTHDQQLAQHLHFINSLKEMKMATEMDSLDSQVYESPNSFQQIMCGRSMKESAGLFMDDVTTVEEAHIRMMDLYCDKATFEDGQKILDLGCGHGSVVLHVAQKYKGCQVTGVTNSSAQKQYILEQCKKLDLSNVEIILADVTTLEMEEKFDRVIIIGLIEHMKNFKLFFQKVSKWMKEGGLLFLENYFHKDFAYHCEKIDEDDWYDGYIFPPGSLLMPSASTLLYFQEDLTVADHWVLPGTHFAKTFEEFLKKIDLRIEEVREIFEAFYGISKEEAMKLSNYWRNFCISAMEIFNYNNGQEWMISHLLYTKK

SEQ ID NO: 1324 - protein, 355 aa, Eschscholzia californica
MDALIQVPYNATVKVMLSSLERNLLPDVVIRKLTKLLLASRLRLGYKPTSDLQLSDLLQFLHSLEEMPIAIKTDTAKTQHYELPTSFFNLVLGSHMKYSCCYFTDESKSLEDAEEAMLELYCERAQIKDGHTVLDVGCGWGSLSLYIAQKYSNCKITGICNSVTQKAHIEEQSRELNLNNVEIIVADISTHEMEASYDRILSIEMFEHMKNYKELLKKISNWLKQDSLLFVHHFCHKAFAYHFEDTSEDDWITRYFFTGGTMPSANLLLYFQDDVSVVNHWLVNGKHYAQTSEEWLKRMDKNLNSIKPIMESTYGKESAVKWTVYWRTFFISVAELFGYNNGEEWMVAHFLFKKK

SEQ ID NO: 1325 - protein, 350 aa, Eschscholzia californica
MGSSAGEIMGRLMKGEIEDEELKKLIRHQWDRRIEWGYKPTHEKQLAFNLDFIKGLKEMVMSGEIDTMNKETYELPTAFLEAVFGKTVKQSCCYFKDENSTIDEAEEAAHELYCERAQIKDGQTVLDIGCGQGGLVLYIAEKYKNCHVTGLTNSKAQANYIEQQAEKLELTNVDVIFADVTKFDTDKTYDRILVVETIEHMKNIQLFMKKLSTWMTEDSLLFVDHISHKTFNHNFEALDEDDWYSGFIFPKGCVTILSSSTLLYFQDDVSALDHWVVNGMHMARSVEAWRKKLDETIEAAREILEPGLGSKEAVNQVITHIRTFCIGGYEQFSYNNGEEWMITQILFKKK

SEQ ID NO: 1326 - protein, 350 aa, Eschscholzia californica; identical to SEQ ID NO: 1325

SEQ ID NO: 1327 - protein, 364 aa, Glaucium flavum
MDLMATSKQVKKKEELLKNMELGLVPDEEIRRLIRIELEKRLKWGYKPTHQQQLAQLLDLVHSLKKMKIATEMESLDLKLYEAPFSFVQIKHGSTIKESSSYFKDESMTLDEAEIAMLDLYVERAQIEDGQSVLDLGCGLGAVTLHVAKKYKNCHVTGLTNSVEQKDFIEGKCKELNLSNVKVILADVTSHEMEDKFDRIFAVELIEHMKNYELLLRRISKWMKDDGLLFIEHVCHKTFAYHYEPIDEDDWYTEYIFPAGTLTLSSASLLLYFQDDVSVVNHWTLSGKHYSRSHEEWLKRIDGNMDAVKEIMKSITKTEEEAVKLINFWRIFCMCGAELFGYKDGEEWMMSHVLFKKKQLLQQC

SEQ ID NO: 1328 - protein, 358 aa, Glaucium flavum
MGSNEAQVKKESIGEIMGKLMQGEIGDEELSKRIKEIFGKRLQWGYKPTHQQQLAFNLDFIKSLKEMDMSGEIDTMNEETYELPSAFLEAAFGKTIKQSGCYFKDETTTIDEAEEASHELYCERAQIKDGQTVLDIGCGQGGLVLHIAQKYKNCHVTGLTNSKAQKNYILMQAEKLQLSNVDVILADVTKHESDKTYDRILVIETIEHMKNIQLFMKKLSTWMTEDSLLFVDHICHKTFSHHFEAIDEDDWYSGFIFPKGCVTILSASALLYFQDDVTILDHWVVNGMHMARSVDAWRKKLDKNMELAREILLPGLGSKEAVNGVITHIRTFCMGGYEQFSYNNGEEWMVAQMLFKKK

SEQ ID NO: 1329 - protein, 359 aa, Glaucium flavum
MDSKEVGIMKKESAEEILGRVMKGQIEDEELRELIKFQFERLLQWGYKPTLQQQLAFNLDFLKSLKELEMSGETEAMNKETYELPTAFLEAIFGKTIKISACYFKDELMTLDEAEEACHELYCERAQIRDGQTILDIGCGQGSLILHIAQKYKNCHITGITNSNGQKNYITTQAEKLQLSNVDVILADVTKFDMEKTFDRVSVIGTIEHMKNMALFMKKVSSWMKEDGLLFVDHVCNKTFSHHYEALDEDDWYSGYKFPKGSVTILWANALLYFQDDVSVVDHWLLNGMHMARTQVEWGKKLNKNIEAVKEILEAGLGSKEAANQVITHMRTCGIGGYEQFSYNNGEEWMISHVLFKKK

SEQ ID NO: 1330 - protein, 361 aa, Glaucium flavum
MTMEANNAKKEAIENLWEQMMMGLVPDHEITRLMKSELQKRLNWGYKPTHQQQISQLLDFAKSLRRMEMSLDFDNLELDTKMYETPESFQLIMSGTTLKESSGLFTDETATLDQTQIRMMDLYLEKAKIKDGQSILDLGCGHGALILHVAQKYRNCNVTGVTNSIAQKEFIFKQCKKLGLSNVEMVLADVTKCEMKATFDHIFVIGLIEHMKNFELFLRKVSEWMKSDGLLFMEHYCHKSFAYQWEPMDDDDLFSKYVFPPGSAIIPSASFLLYFQDDLTVVDHWTLSGNHFARTHQEWLKRIDSQSDEIKGIFESFYGISKEEAVKLINYWRVFCLFGVEMFGYNNGEEWMISHLLFKKK

SEQ ID NO: 1331 - protein, 362 aa, Glaucium flavum
MGSNETNGELKTKEMVPDLLKRLESGLVADEELRKLIRFELERRLKWGYKPTHEQQLAELLKLAHSTKQMKIATETDSLNSTMYEVPIPFLQLQFGSAIKESCCYFKDESTTLDEAEVAMMDLYLERTQIKDGQSILDLGCGLGALAFHIVQKYPNCNVLAITNSVEQKEFIEEKCKIRKVENVKVSLADICTLEMKTTFDRIFAIGLLEHMKNYQLLLKKFSNWMKQDGLLFIEHLCHKTLAYHYEPLDEDDWYTEYFFPAGTLTIISSSFLLYFQDDVSIVNHWSLSGKHFSRSNEEWLKRMDMKIDEVKEILEAAFENKDHDITKLINHWRFLAINATEMFGYNNGEEWMVSQVLFKKK

SEQ ID NO: 1332 - protein, 364 aa, Glaucium flavum
MGVEITESSSTTMANKKAEVGELLRKLEHGLLPYDEIRRLMRIELGRRLQWGYKPTHEQQLSQVLKLARSLRTMNIATEIDTLDEQMYEVPIPFLQLMFGSTIKGSCCYFKDDSTTLDEAEIAMLDLYCERAQIKDGQSVLDLGCGQGALTLHVANKYKNCRVTAVTNSVSQKEFIEEQSRRLNLKNVEVMLADITTHEMEDTYDRILVIELFEHMKNYELLLRKISKWLSKDGFLFIEHICHKTFAYHYEPIDEDDWYTEYIFPAGTMIIPSASFFLYFQDDLTVAKQWTLSGKHFARTKEEWLKRLNANVDEVMKIMESFSGSKEGAVKWTNYWRGFCLSGMEMYGYNNGEEWMACHVLFKK

SEQ ID NO: 1333 - protein, 358 aa, Hydrastis canadensis
MAVEAQQPKKAAIVELLKKLELGLVPYDEIKKLIRIQLERRLQWGYKSTYEEQVADVLDLAHALRKMTIAREVETLDSQLYEVPVEFLKIMNGNTLKGSCCYFKDDSTTLDEAEIEMLDLYCERAQIKDGQSVLDLGCGQGALTLHVAQKYKNCRVTAVTNSVSQKEYIEEQSRNQNLSNVEVILADITTHKMDDRFDRILIIELFEHMKNYELLLRKITEWMAQDGLLFVEHICHKTFAYHYEPLDEDDWFTEYVFPAGTMIIPSASFFLYFQDDVSVVNHWTLSGKHFSRTNEEWLKRLDANIDTIKPMFESLTGSEEEAMKLINYWRGFCLSGMEMFGYKNGEEWMASHLLFNKK

SEQ ID NO: 1334 - protein, 361 aa, Hydrastis canadensis
MSEIAMEGKQAKKESIVELLKKLELGLVPDNEIKQLIRIELARRLQWGYKSTYEEQVAQVLNLAHSLRHMKIANEVDTLDSQVYEVSMSFLNIIFGSTMKESCCYFKDDSVTLDDAEVAMLDLYCERAQLQDGQRVLDLGCGQGTVTLFVAEKYKNCHVTAIPNSVSQKEYIDEQCRIRNLVNVEVILADITTFEMDDTFDRIFVIGLFEHMKNYELLLKKISKWMTQDGLLFVDHICHKTLAYHYDPLDEDDWFTEYVFPSGTTIIPSASFLLYFQDDVSVVNHWILSGKHLSRTHEEWLKRLDANIGAIRIMFKSLLGKEEAVLKLVNYWRGFCLSGIELFGYNNGEEWMVSHVLFKKK

SEQ ID NO: 1335 - protein, 357 aa, HCNMT3
MESKQIKKIGSAMEILERLDKGLIPDEELRELVKIQWGRRLKWGYKSTHVQQLEFNLDFVKSLKQMDMSGKMEVINSESYELPVAFLRAMFGKTLKQSCCYFEDESMTLDEAETAAHELYCERAQIKDGQRVLDIGCGQGSLIIHIAQKYKNCHVTGITNSNAQKNIIEEECRNLKLSNVEVILADVTQYDTKDTFDRIILIEAVEHMKNIDLFLKKISKWMKDDGLMFIDCICHKTFGHHFEAIDEDDWYSGYIFPKGSVTLQAASTLLYFQEDVAVVDQWAVSGKHMARTVEEWLKKLDKNIDVAREILEPSLGSKEAVEKVITHSRTFCIGTSEQFSYNNGDEWMISHVLFKKK

SEQ ID NO: 1336 - protein, 350 aa, Jeffersonia diphylla
MSKGVAKLVERMELGLVSDDEVRRLMRILIEKRLKWGYKPTHEEQLTYLTNFIQGLKGMKIAEEIDALDAKMYEIPIAFMQILCGYSLKFSPGFFEDESTTLDESETIMMDLYCERAQVQDGQSILDLGCGHGGFVLHVAQKYKNCKVTGVTNSVSETEYIMEQCKKLGLSNVEIIIADVTKFEPEVTYDRVFAIALIEHMKNYELVLQKLSKWVAQDGFLFVDHHCHKVFPYKYEPIDEDDWYTQYIFPGGTLVLPSASILLYFQEDVSIVNHWTLSGNHPARGFKEWLKRLDDNMDEIKAIFEPFYGSKEEAMKWITYWRVFCITHSEMYAYNGGEEWMISQVLFKRK

SEQ ID NO: 1337 - protein, 358 aa, Jeffersonia diphylla
MDVGEANKKESKNAELLKKLELGLVPDNEIKKLIGIQLERRLKWGYKPIYEQQIAQVLNLAHSLQNMNIADEIETLDEHMYEVPISFLKIMNGSMLKGSSSYFRDDSMTLDEAEIAMLDLYCERAQIKDGQSVLDLGCGQGALTLHVAQKYKNCHVTAITNSVSQKEYIEDQCKSCNLSNVEVILADITKHESDETYDRILVIELFEHMKNYALLLRKISKWISKDGLLFVEHICHKTFAYHYQPLDEDDWFTDFVFPAGTMIIPSASFLLYFQDDVSVVNHWTLSGKHFSRTNKEWLKRLDAEIDTVKEIFKSSLGTEEAAVKFINYWRGFCFSGMELFGYNNGEEWMTSHLLLKKK

SEQ ID NO: 1338 - protein, 356 aa, Jeffersonia diphylla
MDSNQPKKNESVIELLERLDGGQVSLHELKKLVLIQLQKRLQWGYKPTFEQQQAFHVDFIKSLKQMDISGDMERINAEAYELPISFLKTMFGKTLKQSACYFKDESPTLDEAEMVMNNLICERARLKDGQTILDIGCGQGSLVFHIAKKYKNSLVVGMTNSSEQKNYIEEQCRKLSLSNIKVILADVTKYEMEDRFDRVFVIEAIEHMKNIQLFLNKVSKWMKEDGILFVEHVCHKVFPEHFEELDNEDWYAEYIFPKGSVTVHAASTLLYFQDDVTVLEHWIMNGKHMGRTHEKWHNLVKNIDIAKDVLQLAFGSKEAAEKCINHCLNLFAAMSEQFLYNNGEEWMISQIMFKKS

SEQ ID NO: 1339 - protein, 355 aa, Jeffersonia diphylla
MEGLIEMPYNASVKMMLSLLERNLLPDTMVRKLTKLLLAGRLRSCYKPSSELQLSDLLHFVHSLQDMPIAIKTDEPKSQHYELPTSFFQLVLGQNMKYSCCYYLDKSNTLEDAEKAMLELYCERAQIKDGHTVLDIGCGWGSLALFIAQKFNNCKITGICNSTTQKGYIEEQCRHRQLQNVEIIVADITTFEMEASFDRIFSIEMFEHMKNYKELLKKISKWMKQDSLLFVHHFCHKAFAYHFEDTSDDDWITRYFFTGGTMPAANLLLYFQDDVSVVNHWLVNGKHYSLTSEEWLQRMDQNMETIKPIMVLTYGKDSAVKWTAYWRTFFISVAELFGYNNGEEWLVTHFLFTKK

SEQ ID NO: 1340 - protein, 372 aa, Mahonia aquifolium
MAAVEAETNYNNTTTTCDDTKQQEQHKDELLKKWENGSIPDHEIKQLIRAQLERRLRWGYKPTYEQQIAQLLDLAHSLRKMKIADEVDTLDSQMYEVPISFLRIMNGARLKGSCSYFKDDSTTLDEAEIAMLDLYCERAQIQDGHSVLDLGCGQGAFTLHVAQKYKNCRVTAITNSVSQKEFIEDEAKKSNLSNVEVLLADITKHETNDTYDRIVVIELFEHMKNYELLLRKISKWISEDGFLFIEHICHKTFAYHYEPIDEEDWFTTFVFPAGTMLIPSASFFLYFQDDVSVVKHWTLSGKHFSRSCETWLKRIDANLDTVKAIFESFLGNKEAATKYLNYWRGFCFSGMEMFGCKNGEEWMTTHLLLKKK

SEQ ID NO: 1341 - protein, 349 aa, Mahonia aquifolium
MKKAEMVKRLEDGLIPDEEIKKLIKVELKRRLELGYKPTHEQQLAQLLHFAHSLRKMEIANEIEALDSHVYEIPVSFLEIFHGPALKQSSCYFKDESMTLEQAEIAMLDLYCERAEIQDGMSVLDLGCGLGSLALHIAQKCKNCRVTATTNSMSQKQYIENRCKSHHLSNVEVILADVATQNMDDTFDRIMVVGLFEHMKNYELLLRKMSKWLSQDGLLFVDHACHKAFVSHFQPLDDDDWFTEYVFPAETFIIPSASFLLYFQDDVSVVNHWILSGKHFSRSHEEWLKKLDTEVDAVKLLFKSFLESEEAVTKLINYWRGFCFFGMELFAYNNGEEWMSSHVLFKKNE

SEQ ID NO: 1342 - protein, 339 aa, Mahonia aquifolium
MELGLVPEKEIRRLMRIQIQKRLEWGYKPTHEEQLAHLTKFIQNIRGMKMADEIDALDAKMYEIPLPFLQTICGKTLKFSPGYFKDESTTLDESETLMMDLYCERAQVKDGQSILDLGCGHGGFVLHLAQKYRNSIVTGVTNSVSETEYIKEQCKKLGLSNVEIIIADVTKFEPEVTYDRVFAIALIEHMKNYALVLNKISKWVAQDGYLFVEHHCHKVFPYKYEPLDEDDWYTNYIFPGGTLILPSASILLYFQEDVTVLNHWSLSGKHPSRGFIEWLKRLDENIDVIMGIFEPFYGSKEEATKWINYWRVFCITHSEMYAYGNGEEWMLSQVLLKRK

SEQ ID NO: 1343 - protein, 355 aa, Mahonia aquifolium
  misc_feature (86)..(86): Xaa can be any naturally occurring amino acid
  misc_feature (96)..(96): Xaa can be any naturally occurring amino acid
  misc_feature (127)..(127): Xaa can be any naturally occurring amino acid
  misc_feature (138)..(138): Xaa can be any naturally occurring amino acid
  misc_feature (153)..(153): Xaa can be any naturally occurring amino acid
  misc_feature (292)..(292): Xaa can be any naturally occurring amino acid
MDKANERELKRAELFKKLEDDLVTYDEIKQVMRTELAKRLEWGYKPTHQQQLAHLLDFAHALEGMKIANEVETLASEVYETPLPFXEIVLGPAKKXSSCLFEDESTTLEQAEIAMLDLYFERAQIRXGMSVLDLGCGXGSVGLHIARKYKNCXVTCITNSISQKQYIENQCKLYNLSNVKIILADIVAHDTDDTFDVVLVIGVIEHMKNYALLLNKISKWMAKDGLLFVEHLCHKTFPYHFEPLDEDDWYSNFVFPTGTLTMPSVSFLLYFQADVSILNHWILSGKNFSRTXEEFLKRIDANVDAIKDGLKPSLGSEGVAKLISYWRGFCLTGMEMFGYNNGEEWMVSQVLFKNK

SEQ ID NO: 1344 - protein, 360 aa, Menispermum canadense
MAVGSGDMEDKKARVAELLKKLELGLVPYDEIRRLIKVELERRLRWGYKPTYEQQTADVVNFARSLRKMSIATEIDTLDSQMYEVPISFLKLMFGNTIKGSCCYFKDDTVTLDEAEIAMLDLYCERSQIKDGQRVLDLGCGQGALTMHVARKFRNCRVTGVTNSVAQKEFIEEQCKINNLPNVEIVLADITTHKMDDRFDRILVIELFEHMKNYELLLRKISEWMTPDGLLFIEHICHKTFPYHYEPLDEDDWFTEYIFPAGTMIIPSANFFLYFQDDVSVVNHWTLSGRHYSRTHEAWLKNIDANEDAVKAIMESFTGSEEAAVKLMNYWRGFNLSGMELYKYKNGEEWMASHVLFKKK

SEQ ID NO: 1345 - protein, 362 aa, Menispermum canadense
MASVDGKALKPKKAEIVELLKKLELGVVPDEEIKHLVRIQLERRLEWGYKSTYEQQISHVLNLVHSLRQMSIMTEEVETFDSEFYELPISFWKIKLGRAMKQSCCYFKDELTTLDEAEEAMLELYCERAQIEDGQRVLDLGCGYGSLTLYIARKYPNCHVTGLTNSISQKQFIEEQCKDSNLSNVNIILVDVATHETDETFDRIMVVGLLEHMKNYELFLRKLLKWMKQDGFLFIDHVCHKALAYIYEPVDEDDWLPECTFPSGTIVIPSAHFLLYFQDDASVVNHWIINGKNYRRTSEEWLKRIDANANALKAIMGSVSRKEDEAVRLTNYWRTLLLFHIELFKYNNGEEWMVAHILFKKK

SEQ ID NO: 1346 - protein, 362 aa, Menispermum canadense
MAEEAKSAIEVVELLKKVELGLIPDDEMKSFIRIELERRLQWGYKPTHHQQLSQVLNFADSLRGMDIAMDVSSVDWQLYNAPISFLNIIHGRIIKESCCYFEDDSVTVEEAAVAMMDLYCERAKIEDGQRVLDLGCGLGALTMHIAGKYNNCRVTGITTSPSQKQFIEDQCLKHNLLNVEIILADVITLEMDQTFDRILAIELFEHMKNYELLLRKISKWMTSDGFLFVEHLCHKAFPCHFEPLDETDWITNYAFPAGTITMPSAHFLLYFQDDVSIANHWTISGNHCSRTHEELLKRMDEKANAVEAIIESFLGSKESARKWISYCRVLHLLSIELFKYNNGEEWMISHVLFKRKTVHSNM

SEQ ID NO: 1347 - protein, 358 aa, Menispermum canadense
MDAKEAKKESCVAELLERPELGLVPDEEIRKLTRTQLEKRLRWGYKATHEDQLSHLLQFIQCLPSLNMESEGDKPKSWLYETPTSFLQLIYGDTIKESSTYYKDEWSTLEEAITHILDLCCERAKIQEGQRILDLGCGYGALTVHVANKYKSCSVTGVTTSISQKQYITEQCKKLNLSNVEVILEDVATMKMETTFDRIFALGIFEHMNDYKLFLGRISKWMKQDGLLFVEYLCNKTFAYQNKPLDDGDDWYNEYVFPSGGLIIPSSSFLLYFQDDVSILNHWTFSGKHSARTFEKLLKRIDSKIDAIQEIFNECYGSKEDAIKYINYWRVFLITGAEMFSYNDGEEWMGSHFLFKKK

SEQ ID NO: 1348 - protein, 363 aa, Nandina domestica
MAVMEDGNSDKTVISNKNKAELIKKLELGLVPYDEIKRLMGIEMERRLRWGYKPTHQEQLAQLLNLAHSLRKMKIADEVETLDSQMYEVPISFLRIMNGSRLKGSCSYFRDDSTTLDEAEVAMLDLYCERAQIKDGQSVLDLGCGQGALTLHVAQKYKKCRVTAITNSISQKKYIEDQCKYNNLLNVEVILADITKHETNDTFDRIMVIELFEHMKNYELLLRKISQWMSQDGFLFIEHICHKTFAYHYEPLDEDDWFTDYVFPAGTMIIPSASFFLYFQDDLSVINHWTLSGKHFSRTNEEWLKRLDANVDTVKAIFEESLGSEEAAMKFINYWRGFCLSGITMFGYNNGEEWMTSHLLLKK

SEQ ID NO: 1349 - protein, 347 aa, Nandina domestica
SSKLHRPKKEEILEKLDGGLVSEEELKKLVHLQLQKRLQWGYKPSNQQQLAFHLHFIKSLTQMDISGDMEIINSESYELPISFLKTVFGKTLKQSACYFKNESMTIDDAEIAMNDLHCERAMLKDGLRILDIGCGQGSLIFHIAKRYRNCLVTGITNSFVQKNFIEEQCRNLKLSNIKVILADVTKYEMEDTFDRVLIIEALEHMKNVRLFLNKISKWMKADGILFVDHVCHKIFPEHFVGLDEEDWYSEYIFPKGSVTIHAASTLLYFQDDVKVMDHWIVNGKNMARTHEKWLKNLVKNMDVARDILPIALGSKEAAERCINHFRNFHLAMMEQFSYNNGEEWMIS

SEQ ID NO: 1350 - protein, 355 aa, Nandina domestica
MESVTKVPYNASVRMMLSLLERNLLPDTIVRRLTRLLLAARLRLGYKPSSDLQLSDLLHFLHSLQDMPIAIKTDKPKAQHYELPTSFFQLVLGKNMKYSCCYFLHKSDTLEDAEKAMLNLYCERAEIKDGHTVLDVGCGWGSLCLFIAQKYRNCQITGICNSLTQKAYIEEQCRHLQLQNVEIIVADMSTFEMDASFDRILSIEMFEHMKNYKELLKKISKWMKQDSLLFVHHFCHKAFAYHFEDTSEDDWITRYFFTGGTMPSANLLLYFQEDVSVVNHWLVNGKHYALTSEEWLKRMDKNLGTIKPIMELTYGRDSAVKWIAYWRTFFISVAELFGYNNGDEWMVTHFLFRKK

SEQ ID NO: 1351 - protein, 358 aa, Nigella sativa
MEVERKQAKKANIAELLKKLEQGLVPYDEIKRLMRVELEKRLQWGYKPTYEQQLAHLLQLAHSLRHMSIAHEVDTLDSQLYEVPIEFLKIINGSRLKGSCCYFENDSTSLDEAEVAMLELYCERAQIKDGQSVLDLGCGQGALTLYFAQKYKNCRVTAVTNSVSQKEYIEEESKKGGLTNVEVVLADITTHEMAHKYDRILIIELFEHMKNYELLLRKISKWMAKDGLLFVEHICHKTFAYHYEPLDEDDWFTEYVFPAGTMIIPSASFFLYFQDDVSVVNHWTLSGKHFSRTNGEWFNRIDANLDVIKPMFEALTGSKEEAMKLINYWRGFCLSGMEMFGYKDGEEWMASHVLFKRK

SEQ ID NO: 1352 - protein, 357 aa, Nigella sativa
MEATQITKKQGVAELIKRIENGQVPDEEITRMMKIQIQKRLKLGYKSTHEQQLAQLLHFVHSLQKMEMAEEVDTLDSELYEIPLPFLHIMCGKALKFSPGYFKDESTTLDESEVNMLDLYCERAQIEDGQTILDLGCGHGSLTLHVAKKYRGCKVTGITNSVSQKDFIMEECKKLNLSNVEIILEDVTKFETGTTYDRIFAVALIEHMKNYELFLKKVSAWMAQDGLLFVEHHCHKVFAYKYEPIDDDDWYTEYIFPTGTLVMSSSSILLYFQEDVSVVNHWTLSGKHPSLGFKQWLKRIDDNIDEIKEIFESFYGSKEKATKFITYWRVFCIAHSEMYATNGGEEWMLSQVLFKRK

SEQ ID NO: 1353 - protein, 354 aa, Nigella sativa
MGILQSLHEANLIPDVILRKRISSSLSSWLRDACKPTFQQQLSDELNFARSLEKMPIAAVSDKPNSQQYEAPTELFLLAFGKQAKFSCSYFADESTPLDDAEEAMLELYCERAQIKDGHTILDLGCGLGSLCLYIAQRYKNCKITGLSYSTTQKAYIEQICRDRMLDNVEIIHADISTYEMEATFDRVFSIEMFEHMRNYKALLKKIAKWMKDDSLLFVEHCCHKSFSYSFEGTNEEKDISLLESHAHEWYGRYFFTGGTFPSANLLLYFQENVSVKDHWIVNGKHFSKTCNEWLKKVDKNSSAMEPIMRSLYGKDLAIKWTVYWRTYLIFMGELFGYKNGEEWMIAHYLFKKN

SEQ ID NO: 1354 - protein, 358 aa, Nigella sativa
MTMIDGLVQAPYNATVRVMLSSLERNLLPDAVVRKLTRLLLSARLRSGYKPSTEEQLSDLLQFAHSLQDMPIAIKTDEPKAQHYELPTSFFNLVLGKHMKYSCCYFLDNSNTLEEAEKAMLDLYCERAQIKDGHTVLDVGCGWGSLALFIAQRYSNCKVTGICNSTTQKAYIDEQCRDRKLQNVEIIVADISTYEMDASFDRVFSIEMFEHMKNYKELLKKISKWMKSDSLLFVHHFCHKSFAYHFEDTSEDDWITRYFFTGGTMPSANLLLYFQEDVSVVNQWLVNGKHYAQTSEEWLKRMDKELATIKPIMVTTYGKDLALKWTAYWRTFFISVAELFGYNNGEEWMVVHFLFKKK

SEQ ID NO: 1355 - protein, 368 aa, Nigella sativa
MGIHDLVQAPQNAITRLLLSFHEANRTPDMVLRRAMRSSLSAWLNECYKPSYQAQISDLLSFAHSLESMPMSTVADEANSQQYELPTEFFELMLGKYLKYSCNYFVDNSATLDDAEEAMLELYCERAQIKDGHTILDLGCGWGSLCLYIAQKYKNCKITGISYSKTQKAYVDQLCRDRMLDNVEIVFADICTYETEATFDRIFAVELLEDMRNYKALLKMISKWMKEDGLLFVHHCGHKAFSYYFEETNKETNISLSETNAREWVGRYFFTGGTLPSANTLLYFQEDVSIVDQWIVSGNHFARTCKEWLKRMDNNLGNIKPMIQRVYGEDSTIKWTAYWRSFLLFLQEMYGFNNGEEWMITHVLFKKK

SEQ ID NO: 1356 - protein, 356 aa, Nigella sativa
MGSEQTKKESVAELLERLDRGVVPDEEFIELVKIQLDKRLQWGYKPTAEEQVAFHIGFIDALKKMEISGDMEKINSECYEVPISYHSLVFGAALKQSACYFKHDSMTIDEAEIAMHDLYCERSQIKDGQKILEIGCGQGGLLFHIAHKFKNCNVTGVTNSISQKEFIEEKCRKLEVQNIEVILADITKYETEDGFDRILIIGTVEHMKNVQLFLKKVSKWMKDDGFLFVDHVCHKLFAEQFEALDSDDWYAESLFPKGSVIIHAASTLLYFQDDISVANHWVLNGKHMAYSHERWLKNLLNNRDAAREVLQLSLGSEEAAEKFINHCRMFHLAMKEQFSYNNGEEWMVSHLLFGRK

SEQ ID NO: 1357 - protein, 366 aa, Papaver bracteatum
MVKGDQFQTTTMEETKISQENDLWTNMELGLIPDEEVRRLMKIEIEKRIEWGMKPTQHQQLAQLLDFTKSLRGMKMATELDKLDSKLYETPHSFNQIVNGSTLKESSGLYTDVTTTMDEASIKMMDLYCERANIKDGQTILDLGCGPGPLVLHIAKKYSNCKITGVTNAFSQREYILEECKKLSLSNVEIILADVTSLDLETTFDRVFVIGFIEHMKNFELFLRKISKWMKDDAVLFLEHFCHKSFSYHGEPLSEDDWYAKNFFAPGTLVIPSATCLLYFQEDLAVIDHWFLSGNHFARTNEEMLKGIDGKIEEIKDIFMSFYGINEAEAVKLINWWRLFCITGAEMFSYNNGEEWFISQLLFKKK

SEQ ID NO: 1358 - protein, 363 aa, Papaver bracteatum
MCTTMDTTKISQQDDLWKNMELGLISDEEVRRLMKIETEKRIKWGTKPTQQEQLAQLLDFNKSLRGMKMATEVHALENHKIYEIPDSFNQIIGGKESAGLFTDEATTTIEEANTKMMDLYCERAGLKDGQTILDIGCGAGLLVLHLAKKYKNCKITGVTNTSWHKEHILEQCKNLNLSNVEVILADVTTVDIERTFDRVFVIGLIEHMKNFELFLRKISKWMKDDGLLFLEHLCHKSFSDHWEPLSEDDWYAKNFFPSGTLVIPSATCLLYFQEDVTVKDHWLLSGNNFARSNEAILKRIDSKIEEVKDIFMSFYGIGEEEAVKLINWWRLLCITANELFKYNNGEEWLISQLLFKKKLMTCI

SEQ ID NO: 1359 - protein, 358 aa, Papaver bracteatum
MGSIEEVRKESAEETLGRLLRGEINDEELKKLIKYQLEKRLQWGYKSSHQEQLSFNLDFIKSLKKMEMSGEIETMNKETYELPSEFLEAVFGKTVKQSMCYFKHESSTIDEAEEAAHELYCERAQIKDGQTVLDIGCGQGGLVLYIAQKYKKCHVTGLTNSKEQVNYILKQAEKLGLRNVDVMLADVTQYESDKTYDRLLTIELIEHMKNIQLFMKKLSTWMTEDSLLFVEHVCHKTFSHFFEAIDEDDWYSGFIFPPGSVTILAANSLLYFQDEVSVVDHWVVNGMHTARSFDAWRKKVDKNMEVAKEILLPGLGGSHEAVNAVVTHIRTFCMGGYEQFSLNNGDEWMVAHLLFKKK

SEQ ID NO: 1360 - protein, 355 aa, Papaver bracteatum
METLIQVPYNATVRVMLSSLERNLLPDVVIRKLTKLLLASRLRLGYKPSSEIQLSDLIQFAHSLEEMPIAIKTESAKEQHYELPTSFFKLVLGKYMKYSCCYFSDKTATLEDAEKAMLELYCERAQIKDGHTVLDVGCGWGSFSLYIAQKYKSCKITGICNSKTQKEHIEEQCRELQLQNVEIIVADISTFEMEGSYDRIVSIEMFEHMKNYKELLKKISKWMKEDSLLFVHYFCHKAFAYHFEDTSEDDWITRYFFTGGTMPSANLLLYFQGDVSIANHWLVNGKHYAQTSEEWLKRMDKNISTIKPIMESTYGKDSAVKWTVYWRTFFISVAELFGYNNGEEWMVAHFLFKKK

SEQ ID NO: 1361 - protein, 358 aa, Papaver bracteatum
MGSIEEVRKESAEETLGRLLRGEINDEELKKLIKFQLEKRLQWGYKSSHQEQLSFNLDFIKSLKKMDISGEIQTVNNETYELPTEFLEAAFGKSIKSSGCYFKHESATIDEAEEAAHELYCERAQIKDGQTVLDIGCGQGGLVLYIAQKYKKCHVTGLTNSKAQVNYLLKQAEKLGLTNVDAILADVTQYESDKTYDRLLMIEAIEHMKNLQLFMKKLSTWMTEESLLFVDHICHKTFAHFFEAVDEDDWYSGFIFPPGCATILAANSLLYFQDDVSVVDHWVVNGMHMARSVDNWRKALDKNMEAAKEILLPGLGGSHEAVNGVVTHIRTFCMGGYEQFSMNNGDEWMVAQLLFKKK

SEQ ID NO: 1362 - protein, 352 aa, Papaver bracteatum
LKKRGKILERLVNGDIGDEELKKLIKIRFEKILQWGYKPTLQDQLTSNIDFIKSLKEMEMSGDLETMNSETYELPTAFLEAALGNTLKQSACYFEDESMTLDEAEIAAYELNSERAKIEDGQTILDIGCGFGGLVLHIAQKYKNCHVTGIANSTAQRNYILSQIEKLKLWNVDIILADVTKFDFVTEKKFDRILVIEAIEHMKNIQLFMKKISKWMKDEGSFLFVEHLCHTAFNHHFEALDEDDWYTSYVLPKGSVTILSLTALLYFQDDVSVVDHWLLNGMHMARSQEEWAKKLDKNLDVAKKELKQGLGSEEAANQVITHLRTFFVGGAVQFSFNNGEEWMISQLLFKKK

SEQ ID NO: 1363 - protein, 357 aa, Papaver bracteatum
MQLMAKEELLRNMELGLIPDQEIRQRIRIELEKRLQWGYKETHEEQLSQLLELVHSLRGMKMATEMENLDLKLYEAPMEFLKIQHGSNMKQSAGYYTDESTTLDEAEIAMLDLYMERAQIKDGQSVLDLGCGLGAVALFGANKFKNCQFTGVTSSMEQKDYIERKCKELKLTNVKVLLADITTYETEERFDRIFAVELIEHMKNYQLLLKKISEWMKDDGLLFVEHVCHKTLAYHYEPVDAEDWYTNYVFPAGTLTLSSASMLLYFQDDVSVVNQWTLSGKHYSRSHEEWLKNMDKNIVKFKEIMKSITKTEEEANKLLNFWRIFCMCGAELFGYKNGEEWMLTHLLFKKKLRTPGK

SEQ ID NO: 1364 - protein, 357 aa, Papaver bracteatum
MGSIDEVKKESAGETLGRLLKGEIKDEELKKLIKFQFEKRLQWGYKSSHQEQLSFNLDFIKSLKKMEMSGEIETMNKETYELPSEFLEAVFGKTVKQSMCYFKHESATIDEAEEAAHELYCERAQIKDGQTVLDIGCGQGGLVLYIARKYKKCHVTGLTNSKAQVNYLLKQAEKLGLTNVDAILADVTQYESDKTYDRLLMIEAIEHMKNLQLFMKKLSTWMTEESLLFVDHVCHKTFAHFFEAVDEDDWYSGFIFPPGCATILAANSLLYFQDDVSVVDHWVVNGMHMARSVDIWRKADKNMEAAKEILLPGLGGSHEAVNGVVTHIRTFCMGGYEQFSMNDGDEWMVAQLLFKKK

SEQ ID NO: 1365 - protein, 358 aa, Papaver bracteatum
MGSIEEVKKESAEETLGRLLRGEINDEELKKLIKYQLEKRLQWGYKSSHQEQLSFNLDFINSLKKMGMSGQVEAFTNEVYELPTECFEAAYGKSMKLSGCYFKHESSTIDEAEEASHELYCERAQIKDGQTVLDIGCGQGGLVLYVAQKYKNCHVTGLTNSKEQVNYILKQAEKLGLRNVDVILADVTQYESDKTYDRILVIGVVEHMKNMQLFIKKLSTWMAEDSLLFVDHSCHKTFNHFFEALDEDDWYSGYIFPPGCATFLSADSLLYFQDDVSVVDHWVVNGMHFARTVDAWRKKLDKNMEAVKEILLPGLGGNHEAVNGVITHIRTCCVGGYVQFSLNDGDEWMNAQLLFKKK

SEQ ID NO: 1366 - protein, 365 aa, Sanguinaria canadensis
MASDHEVSNKELKKKKEVITELLKRLESGLVSDEELRGLIRFELERRLRWGYKPTHEQQLAQLLNLAHSMKQMKIATEIDALNSTMYEVPIPFLQIQLGSTLKESCCYFKDESTTVDEAEIAMMDLYLERAQIKDGQSILDLGCGLGALAFHIAQKYTNCNITAITNSVRQKEFIEEKCKILNVSNVKVSLADICTLEMEATFDRIFAIGLIEHMKNYELLLKKFSEWMKQDGLIFIEHLCHKTLAYHYEPLDEDDWYTEYFFPAGTLTLISSSFLLYFQDDVSVVDHWTLSGKHFSRSNEEWLKRMDEKIDEVKEIFESVSDSKDDDVTKLINHWRFFCISSAEMFGYNNGEEWMISQVLFKKK

SEQ ID NO: 1367 - protein, 353 aa, Sanguinaria canadensis
MEMIADLLKRLEAGLVPDDEIRSLIRVELERRLKWGYKSTHQEQLDQLLNLAHSIKKMKIASTEMDGLTSTMYEVPISLVQIQLGSHLKESCLYFKDETTTVDEAEIAMMDLYLERAQIKDGQSILDLGCGLGSVCFHIARKYTSCNITAVTNSVSQKEFIEEKSKTLNVPNVKVLLADITTLEMDDTFDCLFAIGLIEHMENYELLLRKLSDWMKQDGLLFIDHVCHKTLSYHFEPMDEDDWYTNLLFPAGTLTLVSASFLLYFQDDLSLVDHWSMSGKHFSRTNKEWLKNIDGKMDKIREIVKSITDSEEEVVKLINHWRMLCINSSEMFGFNDGEEWMNSHVLFKKKKQI

SEQ ID NO: 1368 - protein, 365 aa, Sanguinaria canadensis
MGGSNEEGKKKINGGLSARAGEIMGRLMKGEIGDDELKKLIRNMWERRLQWGYQPTHHQQLSFNLDFIRSLKKMDMSGEIETMNEETYELPTAFLEAAFGKTIKQSACYFKDKSTTLDEAEEASHELYCERAQIKDGQTVLDVGCGQGGLVLHIAQKYKNCRVTGITNSKAQMNYIVMQAEKLQLSNVDVILADVTKFDSDQTYDRILVIETIEHMKNIQLFMKKLSTWLKKDSLLFVDHICHKTFSHHFETLDEEDWYSGFIFPKGCVTLPSASALLYFQDDVSVVDHWVVNGMHMARSVEEWGKKLDKNMEAAREILEPGLGSKEAVNQVITHIRTFCIGGYEQFSFNNGEEWMVAQMLFKKK

SEQ ID NO: 1369 - protein, 363 aa, Sanguinaria canadensis
MSTVEITETSPPLAKKAEVAELLRNLELGLLPYDEIRRLMRIELGRRLQWGYKPTHEQQLSQVLKLARSLRTMNIATEIDTLDEQMYEVPIPFLQLMFGSTIKGSCCYFKGDSTTLDEAEIAMLDLYCERAQIKDGQSVLDLGCGQGALTLHVANKYKNCRVTAVTNSVSQKEFIEEQSRKLNLKNVEVMLADITTHEMEDTFDRILVIELFEHMKNYELLLRKISKWMSKDGFLFIEHICHKAFAYHYEPIDEDDWYTEYIFPAGTMIIPSASLFLYFQDDLSIANHWTLSGKHFARTKEEWLKRLDANEEEVMKIMEPFSGSKEGAVKWINYWRGFCLSGMEMYGYNNGEEWMASHVLYKK

SEQ ID NO: 1370 - protein, 349 aa, Sanguinaria canadensis
MGGVADLLKKMELGLVPEEEIRRLMRIIIEKRLEWGYKPTHAEQLDHLTNFIQCLRGMKMADEIDALDAKMYEIPLPFMQTICGSTLKFSPGYFKDESTTLDESEIHMMDLYCERAEVKDGHSILDLGCGHGGFVLHVAQKYKNSIVTGVTNSVAEKEFIMTQCKKLCLSNVEIILADVTKFEPETTYDRVFAIALIEHMKNYELVLEKLSKWVAQDGFLFVEHHCHKVFPYKYEPLDEDDWYTEYIFPGGTIVLPSASILLYFQKDVSVVNHWSLNGKHPARGFKEWLKRLDENMDAVKAIFEPFYGSKEEAMKWITYWRVFCITHSEMYAYNNGEEWMLSQVLFKRK

SEQ ID NO: 1371 - protein, 355 aa, Sanguinaria canadensis
MAALIQVPYNATVRLMLTSLEKNLLPDVVIRKLTKLLLASRLRLGYKPTSELQLSDLLQFAQSLEDMPIAIKTDKPKVQHYELPTSFFKLVLGKYMKYSCCYFSDKSKSLEEAEQAMLELYCERAQIKDGHTVLDVGCGWGSLSLYIAQKYSNCKITGICNSATQKAHIEEQCRDLQLQNVEIIVADISTFAMEATYDRIVSIEMFEHMKNYKELLKKISKWMNHDSLLFIHHFCHKAFAYHFEDTNEDDWITRYFFTGGTMPSANLLLYFQEDVSIVNHWLVNGKHYALTSEEWLKRMDQNLDSIKPIMESTYGKDSALKWTAYWRTFFISVAELFGYNNGEEWMVTHLLFKKK

SEQ ID NO: 1372 - protein, 365 aa, Sanguinaria canadensis
MDRSSEWISEKRISAKEMEKKAEMIRKLELGLIPDDEIKRLLGIQMENRLRWGYKPTHEQQLAQLLDFAHSLRKMKIADEIESLESQLYEMPVSFMKIMNGSKLKISSSYFKDDSMTLDEAEVAMLDLYCERAQIKDGQTILDLGCGMGAFTLHVAEKYKSCRVTSITNSVSQKEYIEDQCRSNNLLNVEVILADITKYEMYDTYDRIMAIGLLEHMKNYELLLSKISKWMSQDGFLFIDHICHKTLAYQYEPLNEDDWFTDYIFPPGTFMIPSATFLLYFQDDVSVVNHWTLSGKHFERTHEEWLKRIDANIDTVKVILEEALGNKEAAMKFINYFRNLCLFGITMFGYNNGEEWMMSHLLLKK

SEQ ID NO: 1373 - protein, 351 aa, Stylophorum diphyllum
MQLMAKEELLRNMELGLIPDQEIRQRIRIELEKRLRWGYKETHEEQLSQLLELVHSLRGMKMATEMENLDLKLYEAPMEFLKIQHGSNMKQSAGYYTDESTTLDEAEIAMLDLYMERAQIKDGQSVLDLGCGLGAVALYGANKFKNCQFTGVTSSMEQKDYIERKCKELKLTNVKVLLADITTYETEERFDRIFAVELIEHMKNYQLLLKKISEWMKDDGLLFVEHVCHKTLAYHYEPVDAEDWYTNYVFPAGTLTLSSASMLLYFQEDVSVVNQWTLSGKHYSRSHEEWLKNMDKNIVKFKEIMKSITKTEEEANKLLNFWRIFCMCGAELFGYKNGEEWMLTHLLFKKK

SEQ ID NO: 1374 - protein, 360 aa, Stylophorum diphyllum
MGVEITESSNAKKAEVAELLRKLELGLLPYDEIRRLMRIELGRRLQWGYKPTHEEQLAQVIKLARSLRSMNIATEIDTLDEQMYEVPIPFLQLMFGSTIKGSCCYFKDESTTLDEAEIAMLDLYCDRAQIQDGQSVLDLGCGQGALTLHVANKYKNCRVTAVTNSVSQKEFIEEKSRKLNLKNVEVMLADITTHEMEDTFDRILVIELFEHMKNYELLLRKISKWMSNDGLLFIEHICHKTFAYHYEPLDEDDWYTEYIFPAGTMIIPSASFFLYFQDDLSVVNQWTLSGKHFARTKEQWLKRLDANVDEVMKIMESFSGSKEGAVKWTNYWRGFCLSGMEMYGYNNGEEWMASHVLFKK

SEQ ID NO: 1375 - protein, 360 aa, Stylophorum diphyllum
MGSNEAPSVNGSSNAGKIMERLMKGEIGDEELSKLVRHMWERRLQWGYKPTHEQQLAFNFDFIKSLKHMDMSGEIDTMNEETYELPTAFLEAAFGKTIKQSGCYFKDETTTLDEAEEASHELYCERAQIKDGQSVLDIGCGQGGLVLHIAQKYKNCHVTGLTNSKAQMNYILMQAEKLQLSNVDVISADVTKFDTDKTYDRILVIEAIEHMKNIQLFMKKLSTWMKEDSLLFVDHISHKTFNHHFEALDEEDWYSGFIFPKGCVTILSSSTLLYFQDDVSVVDHWVVNGMHMARSVEEWRKKLDKNMEAAREILEPGLGSKEAVNQVITHIRTFCLGGYEQFSFNNGEEWMITQMLFKKK

SEQ ID NO: 1376 - protein, 353 aa, Tinospora cordifolia
MAVTKREKVEAILKKLELGLIPDGEIRKMIRVELERRLEWGYKPTHEQQTAEVVNFAQSLRKLSIAMEMDTLDTEMYEVPISFLKIMFGNTIKGSCCYFKDENTTLDEAEVAMLDLYCERSQIKDGQRVLDLGCGQGALTMHVARKYKNCYVTGITNSVSQKEYIEEQCRINNLPNVEVILADITTHETEDKFDRILVIELIEHMKNYELLLRKFSQWLTPDGFLFIEHICHKTLAYQYDPVDEDDWFTEYVFPSGTMIVPSANFLLYFQDDVTVVNHWTLSGMNYSRTHEAWLKNIDANAEAVKEIMVSFTGSEEAAVKQMNYWRGFNLSGMELYKYKNGEEWMACHILFKK

SEQ ID NO: 1377 - protein, 356 aa, Tinospora cordifolia
MAPGANKGEIAADLRKKMDMGLIPDEEIRRVIKMELGKRLQWGYKPTYQEQTAQLVDFAHSLRKMSMAIEIDALDSKMYEVPISFYKFTSGSMIKQSCCYFKDDFMTLDEAEIAMLDLYCERAQIQDGEKVLDLGCGAGALVFYVAQKYSNCEVTGVTNSVSQKEFIEEQCRNNNISNVKIILADVTTHETDKKFDRIMAIGLIEHMKNYELFIRKISQWMTPNGLLFIEHYCHKVIPYHYEPLDEDDWLTEYIFSVGTLTFPSANLLLYFQDDVSVVSHWIVNGKHPSRTHEEWLKKIDANVGTMKEIMTRFTGSDEAAMKQVNYWRALNLFGIELFKYNNGEEWMVSHLLFKKK

SEQ ID NO: 1378 - protein, 366 aa, Tinospora cordifolia
MEDNNNLLQEEMNVVELLQRPELGLVPDEKIRKLTRLQLQKRLKWGYKPTHEAQLSHLFQFIHSLPSLNMESEDENPKSWLYETPTSFLQLLYGDCIKESDTYYKEDTATLEEAVINMLELYCERARITEGLSVLDLGCGYGALTLHVAQKYKSCKVTGVTSSISQKQYIMEKCKKLNLTNVEIILADVATIEIEAASYDRIFALGIFEHVNDYKLFLGKLSKWMKQDGLLFVEYLCHKTFPYQNKPLDKGDKWYNEYVFPSGGLIIPSASFILYFQNDVSVVRQWTQGGQHSARTFEELLKRIDGNIDKIKEIFIESYGSKEDAVRFINYWRVFLITGVEMFSYNDGEEWMGAHFLFKKKFIMQE

SEQ ID NO: 1379 - protein, 361 aa, Thalictrum flavum
MAVEGKQVAPKKAIIVELLKKLELGLVPDDEIKKLIRIQLGRRLQWGCKSTYEEQIAQLVNLTHSLRQMKIATEVETLDDQMYEVPIDFLKIMNGSNLKGSCCYFKNDSTTLDEAEIAMLELYCERAQIKDGHSVLDLGCGQGALTLYVAQKYKNSRVTAVTNSVSQKEFIEEESRKRNLSNVEVLLADITTHKMPDTYDRILVVELFEHMKNYELLLRKIKEWMAKDGLLFVEHICHKTFAYHYEPIDEDDWFTEYVFPAGTMIIPSASFFLYFQDDVSVVNHWTLSGKHFSRTNEEWLKRLDANVELIKPMFVTITGQCRQEAMKLINYWRGFCLSGMEMFGYNNGEEWMASHVLFKKK

SEQ ID NO: 1380 - protein, 358 aa, Thalictrum flavum
MGSNEAQVKKESIGEIMGKLMQGEIGDEELSKRIKEIFGKRLQWGYKPTHQQQLAFNLDFIKSLKEMDMSGEIDTMNEETYELPSAFLEAAFGKTIKQSGCYFKDETTTIDEAEEASHELYCERAQIKDGQTVLDIGCGQGGLVLHIAQKYKNCHVTGLTNSKAQKNYILMQAEKLQLSNVDVILADVTKHESDKTYDRILVIETIEHMKNIQLFMKKLSTWMTEDSLLFVDHICHKTFSHHFEAIDEDDWYSGFIFPKGCVTILSASALLYFQDDVTILDHWVVNGMHMARSVDAWRKKLDKNMELAREILLPGLGSKEAVNGVITHIRTFCMGGYEQFSYNNGEEWMISHVLFKKK

SEQ ID NO: 1381 - protein, 351 aa, Thalictrum flavum
MIVGGKQELFKKLELGLIPNDEVKKLMRIQLARRLQWGYKSTYEEQIAQVLDLTHSLRHMNIAMEVDTLDSNMYEVPLDFLKIMNGSALKMSSCYFKDDSTTLDEAEIAMMDLHCERAQIKDGHSVLDLGCGHGSLTFYVAQKYKKSHVTAVTNSVSQKEYIEEEARRRNLSNVEVLLADIATHEMADTYDRILVVGLFEHMKNYGLLLKKISEWMAKDGLLFVQHVCHKTFAFHCEPIDEDDWLSEYAFPAGTMIIPSASFFLYFQDDASVVNHWTLSGKHFSRTTEEWLKRLDANVKVIIPMFATITGSEEEAVKLLNYWRGLCFFGVELYGYNNGEEWMESHVLFKKK

SEQ ID NO: 1382 - protein, 356 aa, Thalictrum flavum
METKQTKKEAVANLIKRIEHGEVSDEEIRGMMKIQVQKRLKWGYKPTHEQQLAQLVTFAQSLKGMEMAEEVDTLDAELYEIPLPFLHIMCGKTLKFSPGYFKDESTTLDESEVYMMDLYCERAQIKDGQSILDLGCGHGSLTLHVAQKYRGCKVTGITNSVSQKEFIMDQCKKLDLSNVEIILEDVTKFETEITYDRIFAVALIEHMKNYELFLKKVSTWIAQYGLLFVEHHCHKVFAYQYEPLDEDDWYTEYIFPSGTLVMSSSSILLYFQEDVSVVNHWTLSGKHPSLGFKQWLKRLDDNIDEVKEIFESFYGSKEKAMKFITYWRVFCIAHSQMYSTNNGEEWMLSQVLFKKK

SEQ ID NO: 1383 - protein, 342 aa, Xanthoriza simplicissima
MLKKLELGLVPYDDIKQLIRSELARRLQWGYKPTYEEQIAEIQNLTHSLRQMKIATEVDTLDSQLYEIPIEFLKIMNGSNLKGSCCYFKEDSTTLDEAEIAMLDLYCERAQIQDGQSVLDLGCGQGALTLHVAQKYKNCRVTAVTNSVSQKEYIEEESRRRNLLNVEVTLGDITTHEMAETYDRILVIELFEHMKNYELLLRKISEWIAKDGLLFLEHICHKTFAYHYEPLDDDDWFTEYVFPAGTMIIPSASFFLYFQDDVSVVNHWTLSGKHFSRTNEEWLKRLDANLDVIKPMFETLMGEEEAVKLINYWRGFCLSGMEMFGYNNGEEWMASHVLFKKK

SEQ ID NO: 1384 - protein, 335 aa, Argemone mexicana
MEGEKGIVCVTGGAGYLASWLIKRLLQHGYTVRTTVRSDPQFKEDISHLKSLPEASKNLQVYEADLDKPKSFDDVINGCIGVFHVAHPIDFEGNKMSQDKAIKISIEGTLGILKACLKSKTESRTAVKRVVYTSSVAAAVFISNKKDVEEINENIWTEVETLKKNEFTRNGYLISKTLTERSALKFAEEHDLDLVTLLPSMIVGPFLTSNLPFSLTISQALVLDNKENCKILKNLNNAVHIDDVASAQIYLFECPEAKGRHICSSVDITIHDIAKLMSIKYPELQLPTDLLMEIEEEKPVHISSKKLLNLGFKFKYGFEDMYSDAIQCCKDKGFL

SEQ ID NO: 1385 - protein, 320 aa, Argemone mexicana
MAEYCVTGGTGFIASYIVKALLEKGHKVRATVRDPDNVEKVGYLWEMPGAKERLKLVKADLMVDGSFDDAVNGVDGVFHTASPVLVPYDNDVQATLIDPTIKGTRNVLKSCSKASSVKRVVYTSSCSAVRYRYDVQQVSPLNESHWSDPQYCKNHNLWYAYAKTLAEEEAWKIAKESGIDLVVVNPSFVVGPLIAPQPTSTLLLILGIVKGLRGEYPNLTVGFVHIDDVVAAHILAMEETKAAGRLICSSSVAHFSEIIGMLKSKYPSYPYENKCGDQKGDNNPHSMSSNKIQQLGLPPLKNLNEMFEDCIKSFQNQGFL

SEQ ID NO: 1386 - protein, 328 aa, Berberis thunbergii
MENGGEKGSVCVTGGAGYLASWLIMRLLENGYSVRATARLDPKFNEDVTHLKAFPHASEKLQIFDADLNKPDSFNDVIEGCVGVFHVAHPIDLEGKRPEASVTKTAVDGALGILKACLQAKTVKKVVYSSSMAAAVISKLNVQEIDESQWTDVDFCRTLDVPGISYVISKTVTERESIKFAKEHGLQLVTMLPALIVGPFSSPRIPESVAIALSLFNGDPEKPLPAWNTNLVHVDDVVAAQIFLFESPKAEGRYVCCSTNTTVPELAKFITGKYPELKVRPELLSDVGSENIVRLSSNKLLGLGFEFKHGLEGIFDGAIQCCKEKNLL

SEQ ID NO: 1387 - protein, 326 aa, Berberis thunbergii
MDVKGKVCVTGASGYMASWLIKRLLLSGYHVCGTVREPGNSKKVAHLWQLEGAKERLQLLKADLMEDGSFDDAVMGCHGVFHTATPVLTPNMVKSDPKAKILAPAIKGTLNVLRSCKKNPYLKRVVLTSSSTAIRVRDEVDPNIPLDEMSWSSVERCQRLQIWYALSKVLAEKAAWEFAEEEGIDLVTVLPSFIIGPSLPLDLSLTASDILGLLNGVSERFTQLGRMGYVHIDDVALCHILVYEESSAQGRYLCSSVVLDNNDLASFLALRYPSLPIPKRFEQLDRPSFDFNTSKLKSLGFNFKGIEEMFDDCVASLKEQGHISQT

SEQ ID NO: 1388 - protein, 320 aa, Berberis thunbergii
MPEFCVTGGTGFIAAYLVKALLEKGYNVRATVRDPEDVEKVKFLWEMNGAKERLKLVKADLMVDGSFDDAIQGVDGVFHAASPVLVPQDDHIQETLIDPIIKGTINVLSSCSKSRTVKRVVLTSSCSSIRYHYDVQNVSPLNETHWSDPEYCKHYNLWYAYAKTLGEKEAWRLAEEKGINLVVINPSFVVGPLIAPQPTSTLLMILRIIKGKLGEYPNTALGFVHIDDVVSAHMLAMEESEASGRFICSSKVAHWSDIIKMLKAKYPSYPIETKCAKKKGDDKLHSMDTSKIEQLGLRAFKTLPQMFDDCIKSFQDKELL

SEQ ID NO: 1389 - protein, 333 aa, Corydalis chelanthifolia
MEGGGEKEKGTVCVTGGAGFLASWIIMRLLQHGYTVRTTFRSDPEFKEDVSHLNALPGASEKLEIFEADLGKPGSFTEAINGCIGVFHVAHPNDFTGKTTQDQMVKLSVEGTLGILKACLDSKTVKRVVYTSSIAAAGLMNDAKDVKEMTEQIWTEVDAFRTLNIPGISYAVSKTLTERAAIEFAEENGLDLVTLLPSMVVGPFMGSNLPTSVSLGLSLVFGDEELLKAIKPSCSSVHVDDVASAEIFLFECPEAKGRYICSAAENTIHDLVKFLTVKYPELQLHTHLLKEIGEAKPGHVSSKKLMSMGFKFKYGFEETYDEAIKCCKAKGLI

SEQ ID NO: 1390 - protein, 331 aa, Corydalis chelanthifolia
MGVQRERGIVCVTGGAGFLASWIIKRLLERGYSVRTTIQSNPDFKEDVSHITSLPGASKKLQIYEADLGKPDSFSEAINGCIGVFHVAHPTDFTGKTSQEEMIRISVEGTLGILRSCLDSKTVKRVIYTSSTVAAGLGTSIEDTKVINEQMWTNVDAFKSTLNAPGISYAVSKTITERAAIDFAHERGLDLVTLLPSMVIGPFLGSYLPMSVSFALSLIFGNEELLKHMKPTSVVDIDDVASAQIFLFESSEAKGRYICSAGEKTIHEVARFLQKKYPELQMQTEILKEIEEEEPVHTSSKKLTSLGFNFKYGFEEMYDNTIKCCKQKGLL

SEQ ID NO: 1391 - protein, 332 aa, Corydalis chelanthifolia
MGVQLEGGIVCVTGGAGFLASWIIKRLLEQGYSVRTTIQSDPEFKEDVSHITSLPGALEKLKIFEADLGKPDSFSEAIDGCIGVFHVAHPIDLSGKTSQEQMIKLSVEGTLGILKSCLDSKTVKRVIYTSSTLAAGLGTSFEDTKEINEQMWSNIDALINSTDNAPGTSYAISKTLTERAAIDFAEEHGLDLVTILPSMIVGPFICPNLPNSIAYALSFVFGNEELLKYLTPTSVVHVDDVASAQIFLLECSEAKGRYICSVGEKTIHEVTKFVQTKYPELKVQTQVLKEIEDEQPVHTSSKKLISMGFKFKYGLEELYDETIQCCKEKGFL

SEQ ID NO: 1392 - protein, 331 aa, Corydalis chelanthifolia
MGGQREREIICVTGGAGFLASWIIKRLLEHGYSVRTTVQSNPEFKEDVSHITSLPRASKKLKIYEADLEKPDSFFDAINGCTGVFHVAHPTDFTGKTSQEQMIKISVDGTLGILKSCLDSKTVKRVIYTSSTVAAGLGLSINDTEAINEQMWTDVDTFKNTLNAPGISYAVSKTITERAAIDFAREHGLDLITLLPSMVIGPFLGSNLPMSVSFALSLIFGNEELLKHMKPTSVVDIDDVASAQIFLFECSEAKGRYICSNGEKTIHEVARFLQKKYPKLKIQTEILKEIEEEEPVHTSSKKLLSLGFKFKYEFEEMYDETIKCCEENGFL

SEQ ID NO: 1393 - protein, 344 aa, Corydalis chelanthifolia
MGATVIDQENTDDQEMVMRKGPVVVTGAAGYIGSWLVMRLLQHGYTVRATVRDPTNVGKTKHLVELPGAKERLTIWKADMDDEGSFDDVVRGCTCFFHLATPMDFESNDPENEVIKPAINGVLNVMRSCKKSTTLKRVVFTTSAGTVNVEEVQKPSYDETNWSDIDFCRRTQMTGWMYFVSKTLAEKAAWDFAKENNMDLITIIPPLVVGPFIMNSMPPSMITALALITGNEAHYSILKQIQLIHLDDLCNAHIFLYEHPKAEGRYICSSADPTIYELAKMLKEKYPEYNIPTKFEGIDESIKRVHFSSKKLTDLGFQFKYTMEDMFDGAIQTCREKNLLPLQS

SEQ ID NO: 1394 - protein, 338 aa, Corydalis chelanthifolia
MSITRKKTVCVTGGTGYIAGVLIKKLLEKGYAVNTTVRNPDDEKKISPLLKLQGKYNDLKIFKADLTIEGSFDEAIACCHFVFHVATPIHVHSEDPENDMIKPAVQGTLNVLNSVTKAETVKRVVLTSSATTLSINKLNGVGYVIDEKSWTDVEFLTSEKPPNWGYAAMKTLVEKAAWKFAEENKIDLITIILPLVTGQSLTPEHEPPSMPFAMALLTGNNDLINVMKDLQMLLGSVAMIHLEDAVECHIFLAENESAYGRYNCCPINTGLVELGKFFENRYPQYNVHTDFGDFPAQAKLSISSEKLINAGFKFQHIGLEEIYDESVEYYIALGLLQK

SEQ ID NO: 1395 - protein, 329 aa, Chelidonium majus
MEGEKGTVCVTGGAGFLASWLIMRLLQYGYSVRTTIRSDPKFKEDISHLKARPKAQEKLQIFEADLEKPESFDEAIDGCVGVFHVAHPIDFEGKISQDKMIKTSVEGTIGILKSCLKYKTVKRVVYTSSMGAAMFVSNILDVKEVDENMWTEVDNFKNIPLPGVPYAMSKTITERAAIEFAEEHGLDLVTLLPGMIVGPFLGPNLPISLSLALSMVFGNDEYTKIMRQTNVVYIDDIACAQIFLLECPNAKGRHICSALDITIHDVAKFISFKFPELQLPISLLKEIQEEKPIHVSSEKLLSLGFKFKYGFEDMYDGAIKCCKEKGFLR

SEQ ID NO: 1396 - protein, 328 aa, Chelidonium majus
MEGGSDEKKGTVCVTGGAGYIGSWLIMRLLERGYSVRATVRLDPGLNRDISHLTNLPGASDKLQIFNADLKNPQSFDTAIEGCIGVFLVAYPGNMDQIEIDDVANEMLEEVTLELLRACLKSKTVKRVVYTSSAAAVLVNDKGLMEMDESSWSDVEFCRNVKLRGSSYIITKTLIEQAALKFAEENGLDLVSIIPPMVVGPFICPHLPDSVSMALSIILGNRHPYFAVMQMVHIDDIVSGHIFLFECPNAKGRYICSSMETSVHDIAKFFTTHYPEFELPMNLISEMKEEKPIHLSPKKLLSLGFKFKYDFKDMFDGAIQSCKEKGFL

SEQ ID NO: 1397 - protein, 320 aa, Chelidonium majus
MAEYCVTGGTGFIASYLVKALLEKGHRVRATVRDPENVEKVGFLWEFTGAKERLKLVKADLMMEGSFDDAVNGVDGVFHTASPVNVPYDNDVQATLIDPSIKGTMNVLKSCAKASSIKRVVLTSSCSAVRYRYDVQQVSPLNESHWSDPEYCKSYNLWYPYSKTLAEEHAWKWAKESGIDLVVVNPSFVVGPLIAPYPTSTLLMILGIIKGMQGEYPNFRLGFVHIDDVVAAHILAMEESKASGRLICSSSVAHFSEIIEMLKSKYPSYPFENKCCDRKGDDNPHSMDTSKIRQLGLPAFKTIPEMFEDCVKSFQEKGFL

SEQ ID NO: 1398 - protein, 328 aa, Eschscholzia californica
MEGEKKVVCVTGGAGYLASCLIMKLIQRGYYVRATIRSDPKFNEDVSHLKAIPGAQEKLEIFDADLEDPESFDNIMEGCVGVFHVAQPIAFGGSKEILEKIIKTSLEGTLGILKACLKSKTVKKVVYTSSKAAALDFKNEAKEIDENTWTDVETLRKNEVGDGWYPISKTLSENAALDFAEEHGLDLVTILPSMIVGGFLSSTLPLALRLSLALVLGTEVECRLLAQAGNVVHIEDVVSAHIFLFERPEAKGRYICSSNDITIHDVAKFISVKYPELKLPTELLEEFGKEKAIHYSSKKLLDLGFKFKYGFEDMYTDAIECCKEKGFL

SEQ ID NO: 1399 - protein, 331 aa, Glaucium flavum
MEGGGGEKGTVCVTGGAGFLASWLIKRLLQHGYSVRTTVRSDPKFKEDITHLQVLPGAQEKLQIFEADLEKPDSFDNAIDGCVGVFHVAHPIDFEGKISQDTMIKTSVEGTLGILKSCLKAKTVKRVVYTSSMGAAMFIRNIKDVKEIDESMWTEVDIFKHFEGYGMSYAVSKTLTERAAIEFAEEHGLDLVTILPGMVVGPFDGPNLPVSLSMALALILGNEELAKLMRQANVVHIDDIASGQIFLMECPEAKGRHICSATDITIHGVAKLISIKFPEIQLPIDLLKEIEEEKPIHVSSDKLLSLGFKFKHGFEDMYEGAIRCCKEKGFL

SEQ ID NO: 1400 - protein, 354 aa, Glaucium flavum
MHIYKNEPSRYTSSQYEKGERRMEGEKGIVCVTGGAGHLASWLIMRLLQHGYFVRTTVRSDPKFKEDISHLKSLPEAAEKLEVFEADLEKPESFSEAINGCIGVFHVAHPMEYEQKVSQETIIKISVEGTLGILKSCLKSKTVKRVVYTSSIAAAISMSNDIKEINENVWTEVDIVKNLEGPTVSYAVSKTLTERAALEFAEEHGLDVVTILPSIIVGPSISNNLPVSTALALSSILDQEEYKTLKKAPKPPAAVHIDDIVSAEIFLFESPKAKGRYICSTVDITARDVAKFIATKYPELLLSTDLSKEFKEEEEEKPVHISSDKLLSIGFKFKYGFEDMYDDAIQYCKEKGFL

SEQ ID NO: 1401 - protein, 328 aa, Glaucium flavum
MEGGRDDEKGIVCVTGGTGYIGSWLIMRLLERGYTVRATVRLDPGHNRDISHLTSLPGALEKLQIFNADLQNPQSFNAAIDGCVGVFLVAYPINLDQIEVDDAANGKIVLGTLELLKACLKSKTVKRVVYTSSAATLMVNDKGLMELDESSWSDVEFCRTVKAYGSSYIIPKTLIEQAALKFSEENGLDLVSIIPPMVVGPFICSHLPGSISMAMALILGNRYPRVPITQMVHIDDIVSGHIFLFECPEAKGRYICSSLETSIHDVAKFFTIHYPEFEMPMNLLSEMKEQKPFHLSPKKLLSLGFKFKYGLKDMFDGAIQSCREKGYL

SEQ ID NO: 1402 - protein, 378 aa, Glaucium flavum
MGSLSTTSEDQKMMSKGPVVVTGAAGYCGSWLVMRLLQQGYTVRATVRDPTKIEKTRHLLDLPGAEERLTIWKADLEDEGSFDEVIDGSIYVFHLATPMDFESIDPENEVIKPTIHGVLNVMKSCKKAKTVKRVVFTTSAGTVNVEEHQKPVYDETSWSDIEFCRRVKMTGWMYFVSKSLAEQAAWDFAKKNNIDLISVIPTLVVGPFIMNSMPPSMLTALALVTGNTAHYSILKQIQLVHLDDLCNAHIFLAEHPNAKGRYICSSEDPTIFQLANMLKDRYPEFDIPTKFEGIDESIKPVHFSSKKLKDLGFQFQYTMEDMYDGAIQSCREKKLFPPGLEKDRQNEKKEVTSKVVKEENEKITSVHAVSHAKPAIMA

SEQ ID NO: 1403 - protein, 330 aa, Hydrastis canadensis
MEEEKGIVCVTGGAGCVASWLIMRLLQHGYSVRATVRSDPMFKEDTSHLLNLPEAPEKLQIFDADLENPESFEAAINGCIGVFHLSHPMDFEGKIPLDTLIKTSIEGTLGILKACLKSKTVKRVVYTSSISAAMCISNMNETGQIDESMWSDLDMVRSHNFPAVSYIVSKTLTESAVLEFSKEHGLDVVTILPSAIAGPFLTSYLPVAFSQSLPLIFGKEVQLINMTNTNLVHIDDVASAQIFLFECPIAEGRHICSTIDLSIHGLAKLLSNKYPELELQIPTDDLSKMEETKPLHLSSKKLLNLGFKFKYDLEEMFDGTIQCCKEKGFL

SEQ ID NO: 1404 - protein, 353 aa, Hydrastis canadensis
MVAEGDSVCVTGAAGFIGSWLVMRLLERGYMVKATVRDPDNIKKVKHLLDLPNAKTSLTLWKADLVDEGSFDDAIKGCTGVFHVATPMDFESKDPENEVIKPTIEGMLNVMRSCVKAKTVRRLVFTSSAGTVNVHQHPQQPKYDENCWTDVEFCRNKKMTGWMYFVSKTLAEKAAWEFAKDNNLDFISIIPTLVVGPFLMSSMPPSLITALSPITGNEAHYSILKQIQLVHLDDLSNAHIYLFEHPEANGRYICSSYDSTIIDVANVLRQKFPEYNVPNKFKDVDENLKAVAFSSKRLIDLGFKYKYSKEDMFVEAIVSCREKGLLPLCSETQVNDKSMECEKREARSEGGSD

SEQ ID NO: 1405 - protein, 317 aa, Hydrastis canadensis
MERVCVTGAGGFQASWLVNLLLSKGYMVHGTVRNPDDEKNAHLKELEKASENLKLFKADLLDYDSLFAAINGCSGVFHVASPVPSGAVPNPEVELIEPAVTGTSNVLKACSMAKIKKVVYVSSIAAVMLNPNWPKDKLMDESCWSDKEFCKTTENWYCLSKTEAESQALDYAKKSGLEVVTVCASIIIGPMLQSKMNASSLLLLRMLKDGLETLDNKIRMFVDVRHVAEALLLVYKKPEAEGRYICSAFTLTMKDLNEKLKTMYPNYNYPKQIVGVDEAWDISSEKLLNLGWKYRPLEDTLIDSIKNYQEKGLLHKV

SEQ ID NO: 1406 - protein, 326 aa, Jeffersonia diphylla
MEGKTGTMCVTGGAGYLGSWLVMKLLKRGYSVRATVRLDPEHKKDLSHLKNLPGASEHLKFFNADLNKPDSFDAAIEGCDGVFHVAHPLDFQGNEADPARISMAVEGTLGILKACVNSKTVKRVVYTSSVAAVVLNTTGLMEMDENSWTDLELVETIKAPGSSYIVPKTLAEQAAIKFAQEHGLDLITVAPSLIVGPFICPHFPTSVFLALAVLMGKTDKFQYISITSMVHIEDIVAAHIFLLECPNAKGRFICSALDTTIHDLAKFLSSKYEDFEMPIDSLKEIEERKPLHLSSKKLLDLGFTYKYGLDEIYDGAIQCCKEKGLM

SEQ ID NO: 1407 - protein, 333 aa, Jeffersonia diphylla
MPKKAAVDQKMDFKGKVCVTGASGYLASWLVKRLLLSGYHVKGTVRDPGNSKKLAHLWQLDGAKERLELVKADLMEDGSFDDAIMGCCGVFHTASPVLGPESDPKAEILDPAVNGTLNILRSCKRNPGLKRVILTSSSAAVRVRDDFDPNIPLDETSWSSVEICERFQIWYALSKILAEKAAWEFAKENGIDLVTILPSFLIGPSLPHDLCSTASDVLGLLTGGPNKFSFHGRMGYIHIDDVALCHILLFEEAKAHGRYLCSSFVMDNNDLASFLAQRYPYLPITKRFEPLDRPCYEFNTSKMKSLGFKFKGIEEMFDDCVASLKEQGYILQK

SEQ ID NO: 1408 - protein, 327 aa, Jeffersonia diphylla
MSIGAGKVVCVTGASGYIASWLVKLLLERGYTVKASVRDPNDYNKTVHLRALSRANERLQLFKANLLEEGSFHSVIDGCEGVFHTASPFFHNVTDPQAELIDPAVNGTLNVLGSCAKIPTVKRVVVTSSAAAVVYNGKPRTPEVVVDETWFSDAELCKNLKLWYVVSKTLAEESAWKFAEKNGIDMVAINPAMVIGPLLQPTLNTSAEAILNIIKGGETFPNRTLGWVHVKDVANAHILAFENSSATGRYCLFESVAHYSELVRILRELYPGLKLPEKSEDDKPFAPTYQVSREKAKGLGIDFIPLEIGLKETVESLKEKKFVSFEV

SEQ ID NO: 1409 - protein, 325 aa, Menispermum canadense
MSSGAKKVVCVTGGSGYIASWLVKLLLERGYTVKASVRDPNDPKKIGHLLALPGANERLKLLKADLLEEGSFDSVIDGCEGVFHTASPFFHAVTDPQTELIAPAVKGTLNVLSSCAKTPSVKRVVVTSSMAAVLYYGKPRTPEVVVDETWYSDPEFCKESKLWYVVSKTLAEEAAWKFAKENGLDIVTINPAMVIGSLLQPTLNTSAAAVLNLINGSETFPNYTFAWVHVKDVATAHILAFETPSASGRYCLVERVAHYSDVVKVLHDLYPNLSLPQKCADDKPFVPTYQVSIEKAKGLGIDFIPMEVSLKETVEGLKEKNMISF

SEQ ID NO: 1410 - protein, 321 aa, Menispermum canadense
MEGANERVCVTGAGGFVASWLVKLLLSKGYTVHGTVRDPRDKKNAHLMKLKEGYEKLQLFQADLMNYSSLCAAITGCNGVFHVATPVPPGSDAVLEAELVEPAIVGTLNVLKACSEAKVKRVVVVSSSAAVEMNPNWPKDQVMDETCWSDKEYCKQTKNWYFFSKTVAENEALEYSKGTGLDVVTVCPSIVIGPMLQSTVNGSSLVLIKILKDGIDRVENKVRMLVDVREVAEALLLTYKKPEAQGRYLCVSYMIRMKDLVEKLRSVYPNYNYPKNFTEVEEEDKLSSAKLQSLGWKFRPLEETLADSVKSYQEAGILDKD

SEQ ID NO: 1411 - protein, 329 aa, Nandina domestica
MEGGDKGTVCVTGGAGFLASWLITRLLRHGYSVRATVRSDPKFKEDTTHLMNLPEAQEKLAIFDADLEKPGTFEPVVEGCIGVFHVAHPMDMEGKTPQETITKISVEGTLGLLNACLKSKTVKRVVYTSSTAAAMCVSNLKELQEIDENMWSDVEMLKGLSLPGLSYSISKTLTERAAIEFGAKNGLDVVTLLPAAIVGPFHTPNIPIGVALALALVFGNELACQLAKQLNIVHIDDVASAQIFLLECPKAVGRHICSSADTTIHGLAKFFSARYPEFQMPIDLLSKMEEEKPIHLSSKKLLDLGFKFNNGIEKMYDGAIESCKQKGFL

SEQ ID NO: 1412 - protein, 332 aa, Nandina domestica
MEMEGEKGSGSRVVCVTGGGGYIASWLIMRLLQLGYSVRATARLDPKLKKDLSHLTNLPRASQNLKIFNADLNQPDSFTAAIEGCDGLFHVAHPLDLEDCEVDDAKVNMLVEGTLGVLKACVKSKTVKRVVYTSSVATVVANKTGLMEMDESIWSDIDFVKAYKFPGSSYVAAKTLSEQAAIKFAEEHGLELVTVISSMVAGPFICPSLPSSVCMALALIMGKSDQYINLVKANLVHIDDIVAAHIFLLECPKAKGRYICSAIDTTIHELAKYLSFKYPEFEMPMDSLKGVPEMQPIHVSSKKLMDLGFKFKYGLDEIFDGAIQSCKEKGFM

SEQ ID NO: 1413 - protein, 306 aa, Nigella sativa
MADEEQPSTKLRACVIGGTGYLASFLIKHLLQKGYHVNSTAKDPGNPETISHLLELQNLGELKIFRADLTDEGSFDEAVSGCLVVFHVATPVHFDSEDPENDMIKPAIQGTLNVLKACTKAQTVKRVVMTSSAAAVSINNINNTDPVMDEEWWTDVQYLSSEKPFAWGYPVSKALAEKAAWKYAENNEMDLITVIPSVIAGPSLTPNVPNSVSLAMSLLTGNESLINGLKGMQITSGSISLLHIEDVVRAHIFVAEKQSATGRYICSAVSTSVPELAKFLSKRYPQYVVLSERACSCEVVSGGGVL

SEQ ID NO: 1414 - protein, 330 aa, Nigella sativa
MSSSTTTEGAGKTVCVTGGSGYIASWLIKLLLQRGYTVKATVRDPNDPRQTMHLRELCGAGERLSLFKADLLSEGVFDSIVNDCDGVFHTASPCYFEAKDPQAEIVEPAVKGTLNVLRSCTKSPSVKRVIVTSSIAAVLNNGKLRTPDVVVDETWFSDPEVCKELKLWYPLSKTLAEESAWKFAKDHGIDMVSINPAMVIGPLLQPTLNSSSSIILNLINGAKTYTNAAYGLVDVRDVANAHILAFEVPSATGRICLAEKVCHFSEMVEILHELYPDIQLPTKCATDEPFVQPYQLCTEKARSLGINFTPIGVSLKETVESLKAKKFVNL

SEQ ID NO: 1415 - protein, 319 aa, Nigella sativa
MPEYCVTGGTGFIAAYIVKELLHKGYNVRATVRDPGDAEKVGFLLEMDGAKERLKLVKADLLEDGSFDDAVQGVDGVFHTASPVLVPYDENIQETLIDPCIKGTVNVLKSCSKASSVKRVVLTSSCSSIRYCDEAQKAPLNESHWSDPEYCKSYNLWYAYAKTLGEKEAWRLSKELGIDLVVVNPSYVVGPLIAPQPTSTLLMILGIITGVTDEYPNTMIGFVHIDDVVRAHILAMEESRAAGRLICSSSVVHWSEIIKMLKDKYPSYPMPTKCSDKKGDDTPHSMDTSKINELGLPAFKTVPQMFDDCIKSFQEKGFP

SEQ ID NO: 1416 - protein, 341 aa, Sanguinaria canadensis
MEMEGEKGSGSRVVCVTGGGGYIASWLIMRLLQLGYSVRATARLDPKLKKDLSHLTNLPRASQNLKIFNADLNQPDSFTAAIEGCDGLFHVAHPLDLEDCEVDDAKVNMLVEGTLGVLKACVKSKTVKRVVYTSSVATVVANKTGLMEMDESIWSDIDFVKAYKFPGSSYVAAKTLSEQAAIKFAEEHGLELVTVISSMVAGPFICPSLPSSVCMALALIMGKSDQYINLVKANLVHIDDIVAAHIFLLECPKAKGRYICSAIETTIHELAKYLSIKYPEFEMPMDSLKGAPEMQPIHVSSKKLMDLGFKFLMVWMKYLMEQFKVAKKKGLCRCLLVLELP

SEQ ID NO: 1417 - protein, 379 aa, Sanguinaria canadensis
MGSTTHDQDDQMMVMIKGPVVVTGAAGYCGSWLVMRLLQQGYTVRATVRDPTKIEKTKHLLDIPGAKERLTIWKADLEDEGSFDEVIEGSIYVFHLATPMDFESTDPENEVIKPTIDGVLNVMKSCKKAKTVKRVIFTTSAGTINVEKQQKPIYDETSWSDLEFCRQTKMTGWMYFVSKTLAEQAAWDFAKENNIHFISVIPTLVVGPFITNNMPPSMLTALALITRNEAHYSILKQIQFVHLDDLCNAHIFLAEHPKAEGRYICSSEDPTIFQLANMLSARYPEFDIPTKFEGIDESIKPVHFSSKKLKDLGFQFKYTMEDMFDGAIQSCREKKLFPSDLEKNNQHFDYQKEIIDLAAAKEKIQISSVPAPEKPTIMA

SEQ ID NO: 1418 - protein, 339 aa, Sanguinaria canadensis
MDWKVIGKKTVCVTGGTGYVASLLIKNLLEKGTYAVNTTARNPEDQKKVAHLLILQADHSDLKIFRADLTDEGSFDTAIAGCDIVFHVATPVNFNSQDPENEMINPAIHGTLNVLNACVKSKTVKRVVLTSSAAAVSINNQNGTGFVMDEGCWTDVEFLASAKPPIWGYPVSKTQAEKAAWKFAEENKIDLITVIPSLMLGPSLTLAVPSSIFLGMSLLTGNNELINTLKGMQMLSGSISITHVEDVVNAHIFLAEKESASGRYICCNISSSLPELAKLLSNRYPQYKVPTDFRDFPTKAKLSLSSEKLINEGFSFKYGIEEIYDQTMEYYKSVELLQK

SEQ ID NO: 1419 - protein, 321 aa, Sanguinaria canadensis
MAEEYCVTGGTGFIAAYIVKALLEKGHRVRATVRDPDKVEKVGFLWEFTGAKERLKLVKADLMVEGSFDEAIDGVDGVFHTASPVLVPYDTDIQATLIDPSIKGTMNVLRSCSKSSSLKRVVLTSSCSAVRYRYDVQQVSPLNESHWSDPEYCKSYNLWYPYAKTLAEEQAWKLANESGIDLVVVNPSYVVGPLIAPYPTSTLLMILGIIKGVQSEYPNLAVGFVHIDDVVAAHILAMEESKASGRLICSSSVAHFSEIIEMLKSKYPSYPIVNKCNDKKGDDIPHSMDTSKIRQLGFPAFKTIPEMFEDCIKSFQEKGFL

SEQ ID NO: 1420 - protein, 374 aa, Stylophorum diphyllum >SDINOS1
MGSINIDPTMMKKGPVVVTGATGYCGSWLVMRLLQEGYIVRATVRDPSKIEKTKHLLGLPGAKERLTLWKADLEDKGSFDEVIEGSIYMFHLATPMDFESTDPENEVIKPTINGVLNVMKSCKKSKTVKRVIFTTSAGTVNVEEHLKPVYDETSWSDVEFCRRIKMTGWMYFVSKTLAEQAAWDFAKENNIHLISVIPTLVVGPFIMNSMPPSMITALALITGNKAHYSILKQIQLVHLDDLCNAHIFVATHPKAEGRYICSSEDPTIFQLANMIRDRHPEFDIPTKFEGIDEAIKPIHFSSKKLKDLGFQFKYTMEDMYDGAIQSCREKKLFPPELEKNKKQYDHQKEVLVKEKKISTAVPNAVLQEIEKNIN

SEQ ID NO: 1421 - protein, 320 aa, Stylophorum diphyllum
MAEYCVTGGTGFIASYLVKALLEKGHRVRATVRDPENVEKVGFLWEFTGAKERLKLVKADLMMEGSFDDAVNGVDGVFHTASPVNVPYDNDVQATLIDPSIKGTMNVLKSCAKASSIKRVVLTSSCSAVRYRYDVQQVSPLNESHWSDPEYCKSYNLWYPYSKTLAEEHAWKWAKESGIDLVVVNPSFVVGPLIAPYPTSTLLMILGIIKGMRGEYPNFRLGFVHIDDVVAAHILAMEESKASGRLICSSSVAHFSEIIEMLKSKYPSYPFENKCCDRKGDDNPHSMDTSKIRQLGLPAFKTIPEMFEDCIKSFQEKGFL

SEQ ID NO: 1422 - protein, 321 aa, Stylophorum diphyllum
MAKGTVCVTGASGFLASWLIKRLLLSGYHVVGTVRDPGNDTKLAHLWNLQGAKERLRLVKAELTEEGSFDDAIKGCEGVFHMASPVLGQPTDPQDILKPAIDGTLNVLRSCKKNPSLRRVVLTSSSSTIRVREKLDPKNPLDESSWSSVELCSKLKIWYVLSKTMAEKAAWEFCNENGINLVTVSPSFVVGPSLPPALCSTASDILGLLQGETERFYWHGRMGYVHIDDVALCHILVYEREEAEGRYLCSSTVVDNDELVSILSARYPTLPIPKRFEQHERPYYDFNTNKIKSLGFTFKSIPEMFDDCITSLVAQGHLSIP

SEQ ID NO: 1423 - protein, 459 aa, Argemone mexicana
MSDIMKVEVVSREIIKPLSPTPNHLKTFNLSFLDQLSPPIYVPIILFYPIDCKNDCKSTIESIRGNLKKTLAHTLTKYYPLAGRIKDGSFVECNDDGVDYVEANVYDINGGISEIIQNPDGDILKKLLPFDPYGVEGYNTKVLLSIRINVLEENCGGIVIGICISHKIGDGSSLTTFINDWAAAARKNPSEQIKGPQFDLPSLFPLRDLKGYIPPSAGAEMVEEIVTKKFVFEGSKITELKKKGIVNGGNNDDDDVKKYPSRVEAVSAFIWRRVIGLDQAKKQGGDSNNEAPVTVYGSLHAVNMRSRMNPPLPSNSFGNMYTTTMAFSIINNHADEEEKLGHYQLPNLVEKVKESIKKIDSEYVKKVQTTDELLNSMKHLATGHQMVMLSFSSWCRFPIYEADFGWGKPIWVTTSTFPFKNVVVFMDTKSGDGIEAWVNMTKDDMAAFERDQELLQYVS

SEQ ID NO: 1424 - protein, 446 aa, Berberis thunbergii
MKMKVQVISRESIKPSSPTPPYLKTFNLCFLDQIAPPFYIPIFLFYADNSPNDIENAGLHCRQKRSLSETLTSFYPLAGRINGNTSVDCNDEGANYVEARVSGLLSEVIVQPNVADVLKMFSPCDEPHFDDADTAHGPKFGSKVLLAIQVNVFDCGGIMICVCLSHKISDAYSMSKFINCWAAKTHNCKEEILPISELSSIFPQRDLLGYIPSAFIHRGKGKIVTKRFVFDASKIASLRATGANSSHVSYPTRIEAVSALIWRRFMESTRAKNGLLKEYVAIHAVNFRRRMDPPLKVEGLENTLGNVFGSTFTASQDLDGKKEPHILVSKLRDAISKIDGKYLRRILCGNAYLESFLGGLAGVAKGETGLAIFSSWCRFPWYETDFGWGKPTWVSISGFPCRDLIILMDTRTGDGIEAWVNMLDEDMAEFEQDEKLLEYVSTTPSA

SEQ ID NO: 1425 - protein, 464 aa, Corydalis chelanthifolia
MEGSSPITTASKAGNKLEMADSKSSSVVEVISKETIKPSIPTPEHLKTIKISLLDQLSPPLYVPIILFYTAAAATDDDDKEIYENLEYKSNILKKSLSETLTHFYPLAGRMKDNMVIDCNDEGVDYFEARVSGNMSEFMKPDAVPQFLPYDVSCNYSGNGKIQLGVQVNKFDCGGIAIGVCISHKTADASSMSAFINGWASTARTGATESPTFDLVHLYPPSCVQIPSENSFTTQVEGEKVVTKRFVFDASKIANLRAKLGDDDDDKKTITRVQAVTGLIWKCAMSKWAHTSSSTSSKLSIANLAVNIRWRMDPPLDQLSYGNLLTLATAASTTEGGSLEELVGQLKVALSKIDAETIKYIQGEGGFMRLQELLGRVHEMFAKGDEVEVYMFSSWCRFPVYEADFGWGRPTWVSCSSQPYKNTVILMDTRSGDGIEAWVNLVEDDMTLFQQNQELLEFVSYTDI

SEQ ID NO: 1426 - protein, 270 aa, Chelidonium majus
SFDSTSLFPPSEQLASQVSYPTQDSTSVDKLVSKRFVFDAAKITSAREKLQSLMHDKYKCHRPTRVEVVSALIWKSAVKSAPPGSISTVTHAMNFRKKMDPPLQDASFGNLCVVVTAVLPATTATTTNPATKKVSSTSNEEQVALDELSDFVALLRREIDKVKGDKGCMEKIIQKFIYGHDASVAKDSDVEDKVTALFMTSWCKFGFYEADFGWGTPVWVTTVPLIEPKYKNMVFMNDMKCGEGIEVWVNFLEDDMTKFEHHLREILQLF

SEQ ID NO: 1427 - protein, 471 aa, Chelidonium majus
MIKMDPKIKVVLISNETIKPSSPTPHHLRNFNFSLIDQFSSPIYIPIILFYDQVIDSNIDDDHRSNRLKRSLSETLTRFYPVAGRINGNVSIDCNDEGVDYFETRIQGKMSDFMVRPELYNHLLPSHIVSNIFATDAQLAVQVNVFDCGGLAICFCMSHKIADASSMTTFINDWAATTRGSMAESVGPIFESASLFPARDILKTSIEPVPDTAGVDVVTKRFVFDASMIAALRAKIQGTTVTSVGKYPTRVEAVSGLIWKSTIEMSKVKLESGSSTKPLKAMVVHHSVNLRKRMDPPLADVSFGNIITLTSAVASSTMIMSQEVELEELVGKLRAAISRINISDYINKMLGCDDDDEEFVRLLKVSNRFAKEVNNDDHVDGEDNTDTDADSNADDDDVYWMSSWCRFPVYESDFGWGKPTFVCTKQSYKNVVILMDTRCGGGIEAWVSLVEDDMAIFERNPNLLQFVSTIN

SEQ ID NO: 1428 - protein, 427 aa, Chelidonium majus
MVLKVEIISKETIKPSSPTPIHLRSFKLSFLDQITPPIPFNILFFYPASDGSFDNVKRSDRLKKSLSETLTYFYPLAGTIGDNITVQCDDNGVQFLETQVNCQLSKVLKHPEAQVMKQFLPDPGMMCNELGKGLQLAIQVNMFDCGGMVIGMTVLHKIIDAGSLSTFINAWARTARGTDETLGPRFDSASLFPPNEVPGTTFLPMKMNPNSAEKIVTKKFVFDASNIAALRAKASHSEHVKNPTRVESVSALLWKCAWNAKSKSSVANVIVNFRSRIVPPLPENSFGNLIGMSTTKITNHEEAELHYLARNLRDAIRKINNDYMKELQNDGSLRSTLEAPHEEFNNDEVEVYTMTSWCRFPFYEVDFGWGKPIWISTVNLLVKNGFMLMDTRCGSGIEAWVTLDEQKMAEFESDLDRASQIHFSQNQ

SEQ ID NO: 1429 - protein, 434 aa, Cissampelos mucronata
MEVQIISRENISPSTPVDPHRENSLKLSLLDHLATSNYVTIILFYPSGCGVGNHEDHISKRSDQLKTSLSETLTHFYPVAGRIRDGAAVDCDGQGVEFSEAKAGVRLAEFLKRPNIDDLDKLLPCAPYVTNEELPAKALLGVQANYFDCGGMALGVCFSHKIADGAAMATFIRFWADAANGSSKNALPNPSFDLPSLFPAKDSDGATPSGRGGVGEGSNIVTRRFVFKGEKVAALRGTEVEHPTRVEAVSAFIWERAIAATRAKAGPERASIAVHAVNLRGRMVPPLPSNAFGNASRPTITKCVEFGSDTRSDRHVLVKHLRDAMRRVDGDYVRKLQCGEEGFMNSIEEIQKQFSKGEVVAMNFNSWCRFPFYDANFGWGRPIWVSTTKTPGKNLVILIDSKFGDGIEAWLNMVEEDLVELEKDEEFLSFVSNT

SEQ ID NO: 1430 - protein, 458 aa, Cocculus trilobus
  misc_feature (249)..(249): Xaa can be any naturally occurring amino acid
MSTLIKKNLSSSFWFQVVELGESVAMDQKSSNGNVFELSVKVGEPTLVPPAEDTPKGLYFLSNLDQNIAVIIRTVYCFKSEEKGNERAGEVLKDALAKVLVHYYPMAGRLTISSEGKLIVHCTGEGGVFVEAEADCKMEDIGDITKPDPVTLGKLVYDIPGAKNILEMPPLVAQITKFKCGGFVLGLCMNHCMFDGLGAMEFVNSWGETARGEPLTVPPFLDRSILKARIPPKIEFTHQEFAEIEDISXTSSLYEEEMLYRSFCFDTQKLEQLKKKAMEDNVIAKCTTFEALSAFVWKARCEALMKPDQQIKLLFAVDGRPRFEPPLPKGYSGNGIVLTNSLCNAGEVLENPLSFTVGLVQRAVKMVTDSYMRSAIDYFEVTRARPSLAATLLITTWSRLSFHITDFGWGEPILSGPVTLPEKEVILFLSHGKERKSINVLLGLPASSMKIFQELMEI

SEQ ID NO: 1431 - protein, 430 aa, Eschscholzia californica
MAVMMDKLVRVISKEIIKPSSSTPSHLSPYKLSLLDQVIYPVYVPVVLFFESNHTNSFESESNYHHLLKKSLSNVLTRYYPLAGRIKDNIFVECNDLGVDYFEAKVNGNITEFRSADLLNQLIPTLDMASRTPLIIQVNMFDCGGIAISMCMSHKLFDASSIATFINCWAATARGETEFVIPNFDAHSLFSVRQVSFPVPDTPVELKDGTIENKLVAKRFVFDAANIASLRARIAKTSNGKYPTRVEAVSALIWKSLMNPEAESMSILNQAVNLRRKMDPPLTQESFGNIVTLATTTLIPKNSYSLDELVGHLRVSIHKIDEDYVRKLRGDSGEEFIKWVTKEAGLMNEDGKNMYMMSSWCRFPFYESDFGWGKPVWVTYSVGQALAKNGIVLMDTRDGEGIEAWVKLEEKDMTAFECNENLLEFAYVTK

SEQ ID NO: 1432 - protein, 467 aa, Glaucium flavum
MTYAALPYPLRPCPFTPLDQFSSPHYVPIILFYAAAAPLGDCPTEGNQVDDIDHRSNRLKRSLSETLTQFYPVAGRIKDSSSVDCNDEGIDYYETRIHGKMSAFMTRPREHHHLLPCHIASNILAKDAQLAVQVNVFACGGTAISFCMSHKIADASSMTTFINDWAATNRGSTKTLSPTFKSAFLFPPREILNTLAVPGPDTHGIDNRTIGDVNKAVVTKRFVFDASMIAALRAKIQNTSTPRVGYFPSRVEAVSALIWKSFMEMSKVKKLKIESSSLRKPVKCMVVHHTVSLRKRMDPLLADRSFGNMITLATAVASPTMLMAKQVDVEELVRQLRAAISKINGDYIKKLQSGGDDDEEFLRLVNESGRFAKKVNNGDEVTDHNDDSDDDHEVYWMGSWCRFPLYESDFGWGKPVMVSSYQSYKNVVIMIDTSCGDGIEAWVSLVEDDMAVFERDAQLLEFASTIC

SEQ ID NO: 1433 - protein, 449 aa, Glaucium flavum
MKMKVEVVSREMIKPSSPTPHHLRTFNLSFLDQLAPPIYVPLVLFYKSDEYDNDNNSHFPDIIKKSLSASLTRFYPLAGRIQDEGSVDCNDEGVDYLETKVTNGELSQIIQHPEVHVLQQFLPCDSYSTNQSTPVTSKVLLAVQVNVFEDCGGIVIGICISHTLADASSLSTFINDWAACARGATDQIMDPCFELPTLFPKVDLMGYNTLGSIKKNKQQIVTKRFVFEASKITELKKQSVVETNATNINGDGHRECPTRVEALSAFVWKRFMKLNQAKEEASARVYRVTQAVNLRKRMVPQLPTNAFGNMYSPTFALLVDAEGKGDHPYPTLIVKIGEAIKRIDGDHVRKLQHTDAYFNFYKKQMENAASNNQTSNVMLHFSSWCRFGIYEADFGWGKPTWAATAPLPFKNVVVFMDTRSGDGIEAWVNMTKEDMDEFECDKEFLKFAS

SEQ ID NO: 1434 - protein, 487 aa, Hydrastis canadensis
MDQTQQFHLLRVTFQKILGKMTLNVEVISRETIKPSSPTPHHLKNFKLSHLDQYTPPIGVPIILFYSANHFEKTKMSDRLKKTLSKTLTDFYPLGGKIKDNNSIDCDDSGVEYLETQVKAQLYQFLNCPEADELNQLIPLNLNCTGMSSEIQLAIQVNVFECGGIAIAACISHKVADASSLCTFLSNWAANARGANHVVFPQFDSAPLFPPREVSSLQLSTEGPTHNVVTKRFIFDSSNIAALKAKSANYVENPTRVEAVATFLWRCFMNVASLKPGSIKSFMVNIAVNLRSRMVPPLPDHSFGNLIMAAMPSSTADSKAELHCLVGQLREAIRRYDGDYMKNLQDGDGVSMFYDSMRQAIELFAKGEMGFYTITSWCRFPFYEIDFGWGKPIWASSLNMVHKNVVILMDTKYGDGIEALVTLDEEDMARFECEEELLAFTSPKNIAYVQELHDFTNPIKMAYEQEVLASTSPNGMAYEKRSLISLG

SEQ ID NO: 1435 - protein, 439 aa, Jeffersonia diphylla
MSIQVEIMSRESIKPSTPTPPHLRTFKLGLFDLLAGFDRVSILLFYDNKDTKKIEFSDISRRLKTSLSETLSSFYPIAGRMNGYIAIECNDEGVDYVEARVKAQLEDVIKHRNVDQVLELLSPGDDQEPQLSLKVLLAIQVNLFECGGIVISVCLSHKISDAYSMITFINSWAAKTSDSNQLIHPISQQLSSLYPPSGLDLNSAPFQSTIPNLVTKRFVFDSSNIASLRAEVINNNSSCVPSPTRVELVSALLWRCFMELTRKKNGFLKECAAMHIVDLRKRMDGKGLENALGNLCAPTFTTSRELASENELYVLVGELRDAIRKMDSEFVTKIRRDGEYIQHLEDEYSKGISTGKTGLIMFTSWCRFPLYKANFGWGKPVWATGISARNDFKNVVALMDTRSGDGIEALVRMAEEDMAEFEQDEQLLSFLSSTHCVDC

SEQ ID NO: 1436 - protein, 430 aa, Mahonia aquifolium
MIVNIKETTMVRPSEPTPKRSLWNSNVDLVVPRMHTPSVYFYRPNGSSNFFDANVLKEALSKALVPFYPMGARLKRDEDGRIEIDCDGQGVLFVEAETVSVIDDFGDFAPTLELRQLIPTVDYSGDISSYPLLVLQITHFKCGGVSLGVGMQHHVADGASGLHFINTWSDMARGLDLTIPPFIDRTLLRARDPPRPAFEQVEYLPPPAMKTPLSTPTDSTSVAIFKITREQLNILKAKSKEGGNTINYSSYEMLAGHVWRSACKARGLPYDQETKMYIATDGRSRLRPALPPGYFGNVIFTTTPIAVSGDLSAKPLTYAASVIHEALGRMDDEYMRSALDYLELQPDLAALVRGAHSFRCPNIGITSWSRLPIHDADFGWGRPIFMGPGGIAYEGLAFLLPSPINDGSLSLAISLQSEHMKVFEKILYEF

SEQ ID NO: 1437 - protein, 457 aa, Menispermum canadense
MKKMMKYMKVQVVSKETIKPSSPTPPHLRTYNFSLIDQHIPQLLYIPFILFYSPNIHHKDHDDDHHRQLINIQTQSLDRLKTSLSETLTLYYPLAGRIKNDSIICCEDEGVEFVHTKVIDSPLLELVNKAEPENLAQLLPRHDHQRNEKPPLLSIQFNAFECGGMAIGLWFSHKVADSSSLCTFLHNWASIARGSLSSTEILCPRFDCATHFPPKQLMSPLQHVKTKGEVVSRRYIFDASMIAALKAKASTTINRNSSSSISPSRVLAVIAFLWRTVIAMDREKQLGSIRPLNMGIAVSLRSKMELTLPELSFGNLVAIGMTSAFHEQEVVERIGDLFGKFNRDYVKKLQSGEEYLKLMESLGELEEQICRGEAERYGVTSWCRFPFYEVDFGWGKPVWANVAAFEDNNFFVLMDTRFGEGIEVWVSLGEDDMARFQRQLDRELLVLFNSFSSVGSA

SEQ ID NO: 1438 - protein, 444 aa, Nandina domestica
MKVEKISRDFIKPSTPTPDHLRTFRLSLLDQLAHPVFVPIILFYSSPTTTLDDDHQLGVSNQLKKSLSETLTLFYPLAGRIKDKLLVDCSDEGIEYFESRVNGKISDFMKRDELHHLLPYDFQSTLNVIVGNDSHLIVQVNLFDCGGIAISVSISHKLADAATLTTFINTWASITRQAIPESIVSPTFDSAILYPPREGMSSPFSGAINKHLTSKVQAGQAEKRVTRRFVFDGTKIATLRARYGNSNDEKKKKKNLPTRVEAVTALIWKTAMAATSSPKPSIANIIVDMRRRLDPPLPEQSFGNLATTVARVAPSITKSTGEMDLLGPMRESIRKINSDSLKVLQGDGGFIKFQEFMKMALETNGNELELYRFTSWCRFPVYEADFGWGKPNWVAVASLPFKNTSLLMDDRTGDGIEAWICLLEEDMARFERDQELLDFVTLLD

SEQ ID NO: 1439 - protein, 422 aa, Nigella sativa
MTPKVSVLSRETIKPSLPTPPHLRTFRLSLLDQYSFPVRVPVILFYFNDGENDHTKISKLKTSLSDILTHFYPLAGRIVGDRLINCDDSGVQYLEAQANTQLETFLKYPKADELNQLLPLKLHHNDESSETQLQIQVNTFECGGIAIAASISHMVADTATLCSFINTWAAKSCGCSKTMPPCFDSVALFPPKEIPSFQLPMGDQTQRVISKRFVFHSAKLAALRAKSVSKLEVENPTRVEVVSALVWKCLMNAATRRQGMSFTVNMAVNLRSRMVPPLSDNSFGNLIIGALPSAERGEALHCLVGKFRKMIKRDYSKLPENNGISIFHDGLRKTMEAAARGKIGMYTITSWCRFPFYEADFGWGKPIWATTVNVDHKNIVMLMDTKDGDGIEALVTLDERDMALFECQQELLDFAIPNSMVS

SEQ ID NO: 1440 - protein, 482 aa, Papaver bracteatum
MILYSWDYMEALSSVDVEVISKETIKPTTPTPYQLRNFNLSLLDQYCPIVYVPIILFYPAAVTNSSGSKHHDDLNLLKSSLSETLGQFYPLAGRMKDNIVVDCNDEGIDFIEVKIKSKLCDFMMNPDVRLSLLLPSGVVSMNFVKEAQVIVQVNIFDCGGAAICLCISHKIADACTMSTFTRYWAATTNTARLGGAIGPPNTNPLFLPSFDSASLFPPNEQLASQSAMPSVTYPTEDSRRHIVVSKRFVFDAVKLKSVREKLQVLMHDKYRSRKPTRVEVVSALIWKAAMKSAPSGASSTVNHAVNFRKKMDPPLQDVSFGNLCQVVAALLPATTPETTENSDNKTVNSTSNEVQVALDELNDFVAQLRGEIDKVKGDKSCMERMFLNFMNGYDASETKDSDVEDEVIAFWMTSWCNFGLYDADFGWGKPIWVTTDPFIEPNKNIIYMIDTKCGEGIEVWVNFLEDDMAKFEHHLSEILELF

SEQ ID NO: 1441 - protein, 526 aa, Papaver bracteatum
MILYSWDYMEALSSVDVEVISKETIKPTTPTPYQLRNFNLSLLDQYCPIVYVPIILFYPAAVTNSSGSKHHDDLNLLKSSLSETLGQFYPLAGRMKDNIVVDCNDEGIDFIEVKIKSKLCDFMMNPDVRLSLLLPSGVVSMNFVKEAQVIVQVNIFDCGGTAISVSISHKIADAATMSTFTRYWAATTNTARLGGAIGPPNTNPLFLPSFDSASLFPPNEQLASQSAMPSVTYPTEDSRRHIVVSKRFVFDAVKLKSVREKLQVLMHDKYRSRKPTRVEVVSALIWKAAMKSAPSGASSTVNHAVNFRKKMDPPLQDVSFGNLCQVVAALLPATTPGASPTVNHAVNLRKKMDPPLQDESFGNLCKAVTAILPATTTTTTTKNEDNKTINSTSNEVQVAVLHELNDFIAQLRSEIDKVKGDKDCMEKIIQNFMNGYEYATTKKKNDVEDEVITLWMTSWCNMGLYETDFGWGKPIWVTTDPNIKPNKNIIYMNDTKCGEGIEVWANFLEDDMAKFEHHLSEILELF

SEQ ID NO: 1442 - protein, 516 aa, Papaver bracteatum
MILYSWDYMEALSSVDVEVISKETIKPTTPTPYQLRNFNLSLLDQYCPIVYVPIILFYPAAVTNSSGSKHHDDLNLLKSSLSETLGQFYPLAGRMKDNIVVDCNDEGIDFIEVKIKSKLCDFMMNPDVRLSLLLPSGVVSMNFVKEAQVIVQVNIFDCGGAAICLCISHKIADACTMSTFTRYWAATTNTARLGGAIGPPNTNPLFLPSFDSASLFPPNEQLASQSAMPSVTYPTEDSRRHIVVSKRFVFDAVKLKSVRDLLPSFDAATLFPPSEQLVCPSEVPPTPVSHHNDDSGGEKSVSKRFVLDAVKINSVREKLQGLMHDNYKCTSRPTRVDVVTALVWKAAMKSAPRDGFLPMVNHVMSFRKKMDPPLPDASFGNLCAVVSTAVSPGATATSTNDEVLEEQLAELVAQLRGEKYKVKGDKGCIEKIFLSFVGGDNALWMASWSKFGFYDADFGWGKPVWVTTDLSVVEPNQNLICMIDTKCGEGIEVSAKFLENDMAKFEFHLSEILKLF

SEQ ID NO: 1443 - protein, 457 aa, Papaver bracteatum
MNQFVILKQPTMSNIIVEVISKETIKPSTPTPHQFKNHSLSLIDQYIVPSFVPLIFFFPAVPGLYDHTAGNKQHGDNILLLKRSLSETLSHFYPLAGRVKDNIVVDCNDQGIEFIEAKVSGSMSEFLKKPDDHLSGLLPSKVVCMNYVTNTQVFVQVNSFECHSTAICLCVSHKVADVATITTFIRCWAQTNISVSRTTSIGSKLHPTFDSASLFPPIKQLVSPTMVTPTELDSTPLEESKSISKIISKRFVFDAKMINSVREKISATMVDKYKSRRLSRVEIVSALIWKSFVKLATPGSSSVIVRHAVNLRRRIDPPLPDVSFGNILEFTKLVVGSASTTTQGTSKLHEDLNEFVCQLRESISKMNKGDHDFDMENTENEGRNLWMSSWGSYGSYDIDFGWGKPIWVTTVGPMFAFSDVFYMNDTRCGQGIEVWGNLVEEDMDNFQRNLSKLLERI

SEQ ID NO: 1444 - protein, 447 aa, Papaver bracteatum
MFYFSLQRGLTQHIKSGNVLVNNNQEDMATMSSAAVEVISKEIIKPATPPPYQLTNFNISLFDQYMPPSYTPVILFYPAAVADSTGGSKLHDDLGGLLKRSLSQTLVHFYPMAGRLKDNMVVDCNDQGVDFYQVKIKAKMCDFMMKPDEFPLSLLLPADVVSVNFVKEAQVIVQVNMFDCGGTAISLCISHKIADACTMSTFTRNWAATTNTARLGGAIGPPNTNPLFLPSFDSASLFPPNEQLASQSAMPSVTYPTEDSRRHIVVSKRFVFDAVKLKSVREKLQVLMHDKYRSRKPTRVEVVSALIWKAAMKSAPSGASSTVNHAVNFRKKMDPPLQDVSFGNLCQVVAALLPATTPETTVNSDNKTVNSTSNEVQVALDELNDFVAQLRGEIDKVKGDKGCMERMFLNFMNGYVTKDSDVEDEVIAFWMTSWCNFGLYDADFGWG

SEQ ID NO: 1445 - protein, 437 aa, Sanguinaria canadensis
MNSILWATPTPDHLRTFRLSLLDQLAHPVFVPIILFYSSPTTTLDDDHQLGVSNQLKKSLSETLTLFYPLAGRIKDKLLVDCSDEGIEYFESRVNGKISDFMKRDELHHLLPYDFQSTLNVIVGNDSHLIVQVNLFDCGGIAISVSISHKLADAATLTTFINTWASITRQAIPESIVSPTFDSAILYPPREGMSSPFSGAINKHLTSKVQAGQAEKRVTRRFVFDGTKIATLRARYGNSNDEKKKKKNLPTRVEAVTALIWKTAMAATSSPKPSIANIIVDMRRRLDPPLPEQSFGNLATTVARVAPSITKSTGEMDLLGPMRESIRKINSDSLKVLQGDGGFIKFQEFMKMALETNGNELELYRFTSWCRFPVYEADFGWGKPNWVAVASLPFKNTSLLMDDRTGDGIEAWICLLEEDMARFERDQELLDFVTLLD

SEQ ID NO: 1446 - protein, 441 aa, Tinospora cordifolia
MEIQIISRDKVSPSTPTPDHLKSFKLSYLDQQATSNYVTIILFYPPYSTDEDKNQVEHLKRSDQLKKSLSETLTHFYPVAGRIVNGVTLDCNDKGVEFLEARVKNTRLSDFLIRPNIDELSKFLPCDPYVTTNEALCSNSLLAIQTTYFDCGGIALGFCFSHKIADGASMATFINCWASTAINGSTESIPNLFFDLSSLFPAKDSNGLIAPSGVGMVDNIVTRRFVFDGKKIDALRGEIIFNNSKKNSKEEYPTRVEAVSAFIWKHAIRAARARAGPLRASAALHAVNLRGRMVPASPNHRFGNASRPAITEIVNLESETESHALVKHLRDAIRGMDGDYVRKLQCGEEGFVKSFEEARKNFSKEELLVLNFNSWCRFPFYEADFGWGKPVWVSTTKTLGRNLIILIDTRCGGGIEAWLNMLEEDMDELEHDQEFLSFVSF

SEQ ID NO: 1447 - protein, 449 aa, Thalictrum flavum
ELPSLCLLEIFIRNKMTLNVEVISEETIKPSSPTPNHLKTFQLSLVDQYAPPVHVPVLLFYSANEHNKVENTAHTNRLKESLSEVLTQFYPLAGRITGHEAIDCSDEGVSFSEARISGELKQVLNNPIPQELDQLLPRIDEFYGLGPKVLLSIQVNIFSCGGMILAVCTSHKLLDGSSMSVFLNNWASLSRGDSKLLHPKFNMTSLFPPKDIPSPMPPIGSPHKVVSKRFIFDASNIAALRAITKDAIENPTRVEVVSALIWRCAMNAVRMRTKSLRSSASVVNFAVNLRGRMDPPLSNDFVGNLMIGKSVESSTDIQQKFHSLVSQLRKGLRSIDSGYVKKLQSDNGLSELYDSTIRFFEMDVKGELEAYVITSWCRFPFYEADFGWGKPSWLTSVNLVAKNIIMLMDTNCGNGIEAWVSLIEEDMASFECEPDIITFTSAKSGLELN

SEQ ID NO: 1448 - protein, 435 aa, Xanthoriza simplicissima
MTLDINVLSQETITPSSSTPNHLRNFKLSLVDQYAPPVHISVILFYPANINDRVKIDERTHRLKRSLSEILTHFYPLGGKINNNQFIDCTDEGVNFFETRVNGRQLSQVLNHPIPEELEQLLNKDDFYRLGPKALLSIQANIFDCGGMALGVCISHKAADGSSFGLFLNNWAAITREDNGIPQPILGQTSLFPPKDDVFSYVPAGVSSIPKVVNKIFVFNAGNIAALKAKASHKLYVEHPTRVEAVSALLWRCARNALRTRPGSANSASVATLAMNLRGNMVPALSNLSFGNLMIGTIATSNTESAPELPCLVGELREAKMKVDVDYVRKLQVDDGVSELWNSFMDLNARHIKGELELYTISSWCGFPFYEADFGWGKPMWITSVNLFAPNIFILMDSKCGNGVEACVTLDEEVMARFECEPELIAFTSTTRSAA

SEQ ID NO: 1449 - protein, 302 aa, Argemone mexicana
MAEIMSYPETKRCAVVTGANKGIGFEICRQLASNGIMVVLTSRDKDKGFEAVEKLKSSGLSDVIFHQLDVMNPTSISSLADFIKTHFGKLDILVNNAGIGGVIVDADRFKALNLGAGELNDNPKLKEVMTETFESTEECLKTNYYGVKAVTEALIPFLQLSNSPIIVNVSSSMGMLKNISNGKALEVLCDVDGLTKERIDEVLNMFLKDFKEGLLETKGWAARLSAYIITKACVNAYTRILAKEFPTFRINCVCPGYVKTDINFNTGVLSVEEGAKSPVDLALLPHNGPSGLFFVRSEISSF

SEQ ID NO: 1450 - protein, 308 aa, Argemone mexicana
MATSVNSSTTKRYAVVTGANKGLGLGICKQLAADHSVNIVLTARNEQRGLEAVEKLKESAGLSDDQINFHQLDVADPASVSSLADFVKTKFGRLDILVNNAGIGGVAVYENGFLDQVSKIKNNGTGEVKWDEILTESYELTEQCVQTNYYGAKRMTEALIPLLQLSDSPRIANVSSSMGKLKNLPNEWAKGILNDEQNLTEVRVDEVLNEYLKDYKEGSIQEKGWPRFMSAYVISKAAMNAYTRILAKKYPTFCINAACPGYVKTDINMNTGKLSVEEGAKSVVKLALLPNGGPSGLFFFEGNISSFE

SEQ ID NO: 1451 - protein, 301 aa, Berberis thunbergii
MAEANSTRPTKRVAVVTGSNKGIGYEICRQLACHGGVVVVLTARDTKRGLEAVEKLKESGLSDVFFHQLDVMDSTSIASLAAFIKTQFGKLDILVNNAGIGGATLDSDALKAMRLEGKNAKPNWKEIMTETYEGAVECLKTNYYGVKQVTEALIPLLQLSNSPRIVNVSSSMGLLKNISHDEAKGVLSDADCLTEERVDNMLNDFLTDFKEGLLESKGWPIFLSAYTISKASLNAYTRILAKKLPTFRINCVCPGYVKTDMNANTGSLTVEEGALGPVTLAFIPDDGPSGVFFSGTKEATF

SEQ ID NO: 1452 - protein, 304 aa, Chelidonium majus
MAAEIRSDPETRKRCAVVTGANKGIGFEICRQLASNDVLVVLTSRDTKRGTDAVQSLKDSGVSGVVYHQLDVTDPTTVASLADFIKTQFGKLDILVNNAGIGGIEVDYDGLIALTRGDGELEDNPKFKEVMTQTFELAEECLKTNYYGVKAVTESLIPFLQLSDSARVVNVSSSMGQMKNISNEKAIEILSDVAGLTEERIEELMNEYLKDFKEDLIETKGWPTKLSAYAISKAALNAYTRILAKKFPTYRINCVCPGFVKTDINYNTGVLTVEEGAASPVRLALLPDDGPSGLFFFRAEVSDF

SEQ ID NO: 1453 - protein, 303 aa, Chelidonium majus
MAAEIRSDPETRKRCAVVTGANKGIGFEICRQLASNDVLVVLTSRDTKRGTDAVQSLKDSGVSGVVYHQLDVTDPTTVASLADFIKTQFGKLDILVNNAGIVGVKIDYEGLTNLIKAGEYNNNDKLKKLMTQTFELAEECLQTNYYGVKSVTEALIPFLQLSDSARVVNVSSSTGKLKNVSNENAKKVLSDVDDLTEERIDEVLNVFRKDFKEDMLETNGWPERLAAYTLAKAALNAYTRVVAKKFPTFRINSVCPGVVKTEINNYTGVLPVEEGAKAPVRLALLPDDGPTGVFFFREEVTDF

SEQ ID NO: 1454 - protein, 312 aa, Chelidonium majus
MAKTCPNTVVTKRRCAVVTGGNKGIGFEICKQLSSNGIMVVLTCRDVTKGLEAVEKLKNSNHENVVFHQLDVTDPVTTMSSLADFIKTHFGKLDILVNNAGVAGFSVDADRFKAMISDIGEDSEELVKIYEKPEAQELMTETYELAEECLTINYYGVKSVTEVLIPLLQLSDSPRIVNVSSSTGSLKYVSNETALEILGDGDALTEERIDMVVNMLLKDFKENLIETNGWPSFGAAYTTSKACLNAYTRVFAKKIPKFQVNCVCPGLVKTEMNYGIGNYTAEEGAEHVVRIALFPDDGPSGFFYDCSELSAF

SEQ ID NO: 1455 - protein, 301 aa, Cissampelos mucronata
MAETGATKRCAVVTGGNKGLGLEVCRQLASNGVFVVLTARDEKKGSEAVESLKASGVSDVVFHQLDVADPASVDSLAHFIKNRFAKLDILVNNAGISGSVPTVDDAFEKEKLPEEPGQRMVYMMQSITGTYESSKECLVTNYYGTKRVTEALLPLLQLSNSATIVNVSSSAGLLQGIGHKRAIELLDDIDENTDKKVEEVLNEFLEDYKEGSPEAKGWPSRSLGAYMLSKAAMNAYTRFLAKKFPSFRINCVCPGYVKTDMNFNTGLLTVEEGAEKIVKLASLPDDGPTGLFFRNDEVHAF

SEQ ID NO: 1456 - protein, 304 aa, Cissampelos mucronata
MEETTPTLAEKRYAVVTGGNKGIGFEICRQLASKGIVVILTARYEKRGIEAVEKLESLGVSNVVFHQLDTMDPTSIALLANFVETNFRKLDILVNNAGCNGLVMYSEAYTAFIDAGNHVTDDKVGSLKGIVEQTYEKAEECIETNYFGTKRVTEALLPLLQLSDSPRIVNISSIYSQLKFIANEKIRAELNNVECLKDERLDEVVQQFLKDFKEDQLLQNGWPLTLSAYKVSKAAINAYTRILARKFPKFRINSNHPGYVITDITCNRGLLTPEEGAKRPVMLALLPDNGPSGLYFDQMEVSSF

SEQ ID NO: 1457 - protein, 304 aa, Cocculus trilobus
MAETPVSSAATKRCAVVTGGNKGIGLELCRQLASNGVLVVLTARDEKRGTEAVEKLKGSGLSDVFFHQLDVTNPASVASLADFIKTHFGKLDILVNNAGISGATADFDALNKENLPEEAGPRLFAMMQALSENFEMTKECLETNYHGTKRVTEALLPLLQLSNSARIVNVSSSAGLLQGISHERAKEVFSNIDELTEKNVDELLNEYLKDYKEGSPETKGWPARSLAAYMLSKAAMNAYTRFLANKFPSFRINSVCPGYVKTDINFNTGLLSVEEGADSLLRLALLPNDGPSGLFFRNKEVSIF

SEQ ID NO: 1458 - protein, 293 aa, Eschscholzia californica
MADTRRRYAIVTGANKGIGLEICKQLASNGIFVVLTSRDENRGIEAVGKLKNSGISDVVFHQLDVMNPSSISSLADFIKTQFGKLDILVNNAGISGVTVDADGLKKMEEYDARKENPGFEEIMIETYEMAEECLKTNYYGVKAITKALIPFLEQSNSARIVNVSSTSGKLKNIPDEKVKEIFSNIDELTEERIDEVLNLFLKDFKEGLLKTKGWPTWSAYTISKAALNAYTRILARKLPSFRVNCVCPGYVKTDITYGTGLLTVEEGAKDPVMAALLPDDGPSGVFFFRGKGF

SEQ ID NO: 1459 - protein, 299 aa, Eschscholzia californica
MAMETAETKKRFAVVTGANKGIGFEICRQLASNGVFVVLTSRDRNRGMEAVEKLKNSGLSDVVFHQLDVMNPTTISSLADFITTQFGKLDILVNNAGVGGIIVDVEAFKGMREGHDEHKDKSLKDVMTETYEVVEECLKTNYYGAKAVTEALIPLLELSNSARIVNVSSSMGQLKNIHNKEAKEILGDAEGLTEEKIDEVLNTFLKDFKKDSLESKEWPVFSGYTFSKAALNGYTRILAKKFPTFLVNSVCPGYVSTDINFNTGILTVEEGAKSPVRLALLPDDGPSGLFFIRAEVSEV

SEQ ID NO: 1460 - protein, 302 aa, Glaucium flavum
MAEIRSGSERKRCAVVTGANKGCGLEICRQLASNGVLVVLTSRDIKRGTEAVENLKNSGLPLVVFHQLDVTNPTSIASLADFIKTQFGKLDILVNNAGIIGGIADAEGFRAMAEAYGKPHHKQVMTEVMAETNELSEECLKTNYYGAKAVTEALLPFLQISDSARIVNIASITGKLENISNEMAKKVLSDIDGLTEEKIDEVLNAYVKDLKDNLLETKGWPANGCAYRLSKAALNAYTRILAKKFPTFHVNSFCPGHVKSDINCNTGVLTAEEGVRKPVSLTLLQDDGPSGLFFVHGEVSDF

SEQ ID NO: 1461 - protein, 302 aa, Glaucium flavum
MAEIRSDAERKRCAVVTGANKGIGFEICRQLASNGFLVILTSRDTKRGTDAVEKLKDSGITDVVFHQLDVMDPTSIASLAEFIKTQFGKLDILVNNAGIGGVEVQHDELRALKQAHGEVKDFSKLGEIMTNVNELTEECLKTNYYGVKTLTDALIPFLQLSDSARIVNVSSSLGNLKNIPNEKAKDVLSDVDGLTEQRINELLNEFFKDFKEDLLETKGWPVRISAYILSKAALNAYTRILARKFPTFRINCVCPGYVKTDITYNTGAFTAEEGAESPVRLALLPDDGPTGLFFYRAEVADF

SEQ ID NO: 1462 - protein, 305 aa, Hydrastis canadensis
MEEIVPSNPSSKRYAVVTGGNKGIGLEICRQLASNEILVILTARDEKRGNEAVENLKRSGLSDVIFHQLDVKDPSSIASLANFIKTHFRKLDILVNNAADGGVIIDGEAFRGLRSGFDTVSDERPELLKGIMEQTNEKAEECLKTNYYGTKGVTEALLPFLQLSDSARIVNVTSVYGQLTFISNEKVKSELNNVECLREERLDEILQWFLKDFKEDKVQVNGWPITVSAYKVSKAAVNAYTRILARKFPNMRINCVHPGYVKTDITCNTGFLTAEEGARPLVKLALLPDNGPSGHYFNRMDMSTF

SEQ ID NO: 1463 - protein, 302 aa, Hydrastis canadensis
MEEIVPSNPSSKRYAVVTGGNKGIGLETCRQLASNEIFVILTARDEKRGIEAVENLKRSGLSDVIFHQLDVKDPSSIASLANFIKTHFRKLDILVNNAADIGVIIDGEAWSGFGDVSGDERRELLRGIMKETNEKAEECFKTNYYGTKGVTEALLPILQLSDSARIVNVSSIYGLLKIIPNEKVKSELNNVDCLTEERLDEILQGFLKDFKENKLEANGWPITVSAYKVSKAAVNAYTRILARKFPNMRINCVHPGYVKTDITCNTGFLTAEEGARPLVKLALLPDNGPSGHYFNRMDMSTF

SEQ ID NO: 1464 - protein, 285 aa, Jeffersonia diphylla
MYAVVTGANKGIGFEICRQLASNGVVVVLTARDEKRGAEAVENLKESGLSNVVFHQLDLMNPTGLSSLADFIKAKYGKLDILVNNAAISGSIINTDALRVDSQGQSNLMDTLIQTYELSEECLKTNYYGTKAVTEALLPLLQLSSSPRIVNVSSRLGQLENIPNTWAKGVLSDVDILTEEKIDEVLNEFLKDLREGSLETKNWSTAFSAYRLSKAALNAYTRILAKKLPKINMYCVCPGYVKTDMNSHTGILTVEEGAEGPVKLALNPNGGSSGLFFAHHEVVSF

SEQ ID NO: 1465 - protein, 303 aa, Menispermum canadense
MAETVITSPATKRCAVVTGGNKGIGLELCRQLASNGVLVVLTARDEKKGIEAVENLKGCGLPDVVFHQLDVTDSASVASLADFIKTHFGKLDILVNNAGIGGFSVDNDALKTTKLSDAVEERAQSFFRAIRETYELAKECLETNYYGTKRVTEALVPLLQLSNSATIVNVSSSAGLLKNISNERAKELLSNIDELTEEKVDELLNEFLKDYKDGLSESKGWPVTGSAYKMSKAAMNTYTRFLASKFPSFRINSVCPSYVKTDINFNTGILTVEEGAGSILRLALLPSDGPTGLFFSKMEVSPF

SEQ ID NO: 1466 - protein, 303 aa, Menispermum canadense
MAETISSVAATMKCAVVTGANKGIGFEICRQLASNGVLVVLTARDQNKGLEAVEKLRASGLSDLVFHQLDVMDSASIAALADFIKTHFGKLDILVNNAGIGGVIVDWDALIALKAEVEQKGEQLNLREVTTDGYELAEECLRTNYYGVKELTEALIPMLQLSSSPRVVNVSSSYGQLKIVSNERAKEILSEVDYLTEERVDEVLNGFLKDFKEGLLETKGWPTVLSAYSVSKAALNAYTRILARKHPTFYINCVCPGHVKTETNRNSGMLSTEEGAESLVMLALLPDGGPSGRFFNRKELSSF

SEQ ID NO: 1467 - protein, 302 aa, Nandina domestica
MAETNNKNPATKRYAVVTGSNKGIGLEICRQLACHGVFVVSTARDPKRGIEAVEKLKESGVSDVVFHQLDVTDPISIASLASFIKAQFGKLDILVNNAGIMSAAIVDWDALAATLGESKDEKPNYKEMMEQTYELAEECLKINYYGVKQVTEALIPLLELSDSPRIVNVSSSLGLLKNIPNEEVKKVLSDADSLTEEKVDTLLHAFLNDFKEDLLEPKGWPVILSAYTVSKAALNAYTRILAKKFPTFRVNSVCPGYVKTDINGNTGTLTVEEGAESAVRLAFLPNDGPSGVFFDRKEESSF

SEQ ID NO: 1468 - protein, 299 aa, Nandina domestica
MAETVSNSGTKRCAVVTGANKGLGLEICRQLASKGVLVVLTARDEKRGVEAVENLRQCGVSDVVFHQLDLVNPTSIASLAEFIKDQFGKLDILVNNAGISGSVINNDALRAHGQVIISSIHVLDAMVESFESAEECLKANYYGTKQVTEELLPLLQLSNSATIVNVSSSIGQLKNITNEWAKEMLSDVDGLTEEKIDEVLNEFVKDYREGLLESKSWAPALPAYTLSKAAVNAYTRILAKKFPTIRINCVCPGFVKTDLNSNIGTLTVEEGAEGPVGLALMLDDRSSGQFFSKKEVVSF

SEQ ID NO: 1469 - protein, 307 aa, Nandina domestica
MLLSWFLLFRSSPAFLMPTYLFRCAVVTGANKGIGLEICRQLASNGVLVVLTARDEKRGVEAVENLRQCGLTDVVFHQLDLLNPTSIASLAEFIKAQFGKLDILVNNAAINGIMINTDPLRVQSDWQTIVREAVVQTYELAEECLKANYYGTKGVTEALLPLLKLSNSARIVNVSSRYGQLKNICNKWAEEVLSDVDSLTEGKIDEVLNEFLKDYREGLLESKSWPAAPSAYIVSKSVINAYTRILAKKFPTISINCVCPGFVKTDLNSNIGTLTVEEGAEGPVGLALMLDDRSSGQFFSKKEVVSF

SEQ ID NO: 1470 - protein, 297 aa, Nandina domestica
MAGISTSSTKRCAVVTGANKGIGLEICRQLPSNGVLVVLTARDEKRGVEAVENLRQCGLSDVVFHQLDLMNSTSIASLAEFIQTQFGKLDILVNNAAIHGTIIDNDALKAQSHGNAWSALTGAMVQTYELAEECINTNYHGTKGVTEALLPLLQLSNSARIVNVSSKIGQLENISNEWAKEMLSNVDNLTEEKIDDVLNEFLKDYKEGLLEIKGWPIAPSAYRISKAAVNAYTRILAKKFPMISINCCTPGFVKTDMSAHIGRLSVEDGAKAVVMIALLPDGGPSGLFFVQKEVASF

SEQ ID NO: 1471 - protein, 311 aa, Papaver bracteatum
MAETCPNTVTKMRCAVVTGGNKGIGFEICKQLSSSGIMVVLTCRDATKGLEAVEKLKNTNHENVVFHQLDVTDPITTMSSLEDFIKARFGKLDILVNNAGVAGFSVDADRFKAMISDIGEDSEEIEKIYEKPEAQELMSETYELAEECLKINYYGVKSVTEVLLPLLQLSDSPRIVNVSSSTGSLKYASNETALEILGDGDALTEERIDMVVSMLLKDFKENLIEANRWPSFGVAYTTSKACLNAYTRVLAKKIPKFQVNCVCPGLVKTEMNYGIGNYTADEGAKHVVRIALFPDDGPSGFFYDCSELSAF

SEQ ID NO: 1472 - protein, 305 aa, Papaver bracteatum
MASKMRCAVVTGGNKGIGFEICKQLASNGITVVLTSRDIKKGLEAVEKLKICNKNVVFHQLDVVNPITISSLADFIKAHFGKLDILVNNAGVSGVSIDVDRFREMTSGIGEGSEETEKLLEQLEKPEMKELLTETYELAEECLKTNYYGVKSVTEVLIPLLELSDSPRIVNITSINGSLKNITNETALEILGDVDALTEERIDMVVNMFLKDFKEDLIETKGWPSYVTAYKISKTCLNAYTRILARKYATFRVNCVCPGFVKSDFNCNIGIFTVEEGAKHAVTIALLPDGGPSGFFYERAQLSAF

SEQ ID NO: 1473 - protein, 316 aa, Papaver bracteatum
MLSNSETKIRCAVVTGGNKGIGFEICKQLALNGILVVLTSRDIKKGLEAVENLRSCTAKNVVFHQLDVLNPLTISSLADFIKTRFRKLDILVNNAGVTGFSINDIDRYVAMQQSIIGEKQKEESSFDGLKGELEKQEINDLFIESFELAEHCLKTNYYGVKSVTEILIPLLQLSDSPRIVNLSSMYGNIKNISNKKAMEVLGDVDLLTEERIDEVANMFLKDYKEDALETNGWPGSSSAYKISKACLNAYTRILAKKFSTFCVNSVCPGWVDTDMNYNIGIFTAEEAAKNAITLALLQDNGRPSGQFFDREVATAF

SEQ ID NO: 1474 - protein, 312 aa, Papaver bracteatum
  misc_feature (301)..(301): Xaa can be any naturally occurring amino acid
MLNQKIRCAVVTGGNKGIGFEICRQLASKGITVVLTARDVTKGLKAVEKLNNSFGLANVVFHQLDVMNPIIISSLSDFIGSQFGKLDILVNNAGVSGVITDVAGFTAVVQALIEKDQNRENANLKQMIKNRKANLKQMIKETYESAEECLQTNYYGVKSVTKALIPLLQLSNSPRIVNVSSLAGQLKNVCNEEALGILSDGDGLKEESVDKTVSMFLEDFKDDLLDIKGWPAYLPAYTLSKASLNAYTRILAREFPTFRINCLCPGYVNSDFNCNTGVVTVTEGAKRVVDLALVPDDGPSXLYFIDGEVSPY

SEQ ID NO: 1475 - protein, 304 aa, Papaver bracteatum
MCAVVTGGNKGIGFEICKQLASNGIMVVLTSRDIKKGLEAVEKLKRSNGICSQNVFFGQLDVVNPETISSLADFIKTQFGKLDILVNNAGVSGVSIDVDRFKVLTSGIGKDSEETEKLLEQLQTPEIKELLTETYELAEECLNTNYYGVKSVTEILIPLLQLSDSPRIVNISSIVGSLKNITNETALEILGDVDALTEERINMVAKMFLKDFKQGLIETKGWPNYVTAYKISKACLNAHTRMLAKKFAKFYVNCLCPGLVKSDFNYNTGIFTAEEGAENAVTLALLPDDGPSGFFYERSELSAF

SEQ ID NO: 1476 - protein, 301 aa, Papaver bracteatum
MDSETKNRCAVVTGGNRGIGFEICRQLASNGISVVLTARDVTKGLEAVEKLKNSFGLSNVVFHQLDLMNLVTLPSLVDFIGSHFGKLDILVNNAGILGAITDAASFKALVEAVEMDKNEEKPNLKQVITETYESAVECMQTNYHGVKSVTKALIPLLQLSESPRIVNVSSALGKLKFISNQMALEILNDGDGLKEESVDEIVNMFLKDFKEDILEIQGWHAYLPAYTISKICLNAYTRILAREFPTFRINCLCPGYVNSDFNCNTGVVTVTEGAKRVVDLALVPDDGPSGLYFIDGEVSPY

SEQ ID NO: 1477 - protein, 305 aa, Papaver bracteatum
MNMAETLLNPEVKRCAVVTGANKGIGFEICRQLASNGIFVVLTSRDRNKGLEAVENLKKSGLSNVTFHQLDVMNLTSVSSLAEFIQTHFGKLDILVNNAGIGGVTIVDEDQLRVLMLEDEKYLENPKLKQIWTEPYDEAEKCLQTNYYGVKAVTEAFIPLLELSDSRIIVNVSSAMGMLKNVGNEKAFEVLSNADCLTEERIDVVVNTFLNDLKEGCLEAKGWPTLLSAYTISKASVNAYTRILAKKFPTFRINCVCPGFVKTDMNFNSGVLTVEEGAKSPVRLALLPDSGTSGLFFVREEVSSF

SEQ ID NO: 1478 - protein, 305 aa, Stylophorum diphyllum
MASKMRCAVVTGGNKGIGFEICKQLASNGITVVLTSRDIKKGLEAVEKLKICNKNVVFHQLDVVNPITISSLADFIKAHFGKLDILVNNAGVSGVSIDVDRFREMTSGIGEGSEETEKLLEQLEKPEMKELLTETYELAEECLKTNYYGVKSVTEVLIPLLELSDSPRIVNITSINGSLKNITNETALEILGDVDALTEERIDMVVNMFLKDFKEDLIETKGWPSYVTAYKISKTCLNAYTRILARKYATFGVNCVCPGFVKSDFNCNIGIFTVEEGAKHAVTIALLPDGGPSGFFYERAQLSAF

SEQ ID NO: 1479 - protein, 304 aa, Stylophorum diphyllum
MAAEIRSDPETRKRCAVVTGANKGIGFEICRQLASNGISVVLTSRDTKRGTDAFQSLKDSGVSGVVYHQLDVMDPTSVASLADFIKTQFGKLDILVNNAGIGGIEVDYDGLIALTRGDGELEDNPKFKEVMTQTFELAEECLTTNYYGVKAVTESLIPFLQLSDSARVVNVSSSTGKLKNISNEKAIEVFSDVDGLTEGRIDEVLNEYLKDFKEDLIETKGWPTKLSAYTISKAALNAYTRILAKKFPMFRINCVCPGFVKTDINYNTGVLTVEEGAASPVRLALLPDDGPSGLFFFRAEVSDF

SEQ ID NO: 1480 - protein, 308 aa, Tinospora cordifolia
MAEMSSVFNGSPAAAKRCAVVTGGNKGIGFEVCRQLASKGVLVVLTARDEKRGVEALQKLGGSGNADVAFHQLDVTNSATIASLVDFIKTQFGKLDILVNNAGISGAIINYDLLKLEEARDEEVGRQLEMLLKAHEETSELVEECVKTNYYGTKTVTEALLPLLQLSNSARIVNVSSSLGLLQQISNERAKEVFNNIDEHTEERIDEVLNEFLIDHKKGSLQSKGWSNDISAYKVSKAAMNAYTRILARKFPSFCINCVCPGYVKTDITCNTGIFTAEEGAESIVELALLPIDGPSGLFFSRNQVSGF

SEQ ID NO: 1481 - protein, 304 aa, Tinospora cordifolia
MEENTFSSAEKRCAIVTGANKGIGFEICRQLVSNGVMVILTARNEDRGAKAVETLRESGLSNVVFHQLDIKDTTSIAALVSFIESQFKKIDILVNNAAENGVILDFEGFKAYALEYNGMIDANPEKLSQLTVETYEMAEECLKTNYYGTKAVTEALLPFLQLSDSPRIVNISSISGQLNGFSNEKVKAELNNVDCLIEERIDELLQRFLKDFKENMLKANGWPLVPSAYRVSKAALNAYTRILARKLPSFRINCVHPGFVETDMSHHTGALNAEQGAKAPVMLALLPQDGPSGCYFDQMEMSTF

SEQ ID NO: 1482 - protein, 297 aa, Xanthoriza simplicissima
MAEERCAVVTGGNKGIGLEICRQLASNGILVILTARDEKRGTEAVENLKESGFSNVVYHQLDVKDPSSIASLANFINTRFRKLDILVNNAGVGGVVIESDAFRALKNGFEDVSDENPDKLKGVMEQTYEKSEECLKTNYYGTKRVTEALLPALQLSNSARIVNVSSSYGKLMFIHNESVKLELSNFETLTEERIDELILWFLKDFKEDKLQENGWPITVSAYKLSKAAVNAYTRMLARKFPNMLINCVHPGYVKTDINCNTGLLTAEEGAKGPVKMALLPDNGPSGHYFNQVNMSTF

SEQ ID NO: 1483 - protein, 271 aa, Argemone mexicana
MAGLVRKVLVTGTAGLTGQIVYKKLRERTEQYIPRGLVRSEERKNKMGGSDDIFIGNIKDVKSLVPAIQGIDALIILTSALPKIKPKPGFIPSKGERAENYVREDGSFDEMPECYFEDGGSPEEVDWIGQKNQIDVAKAAGVKQIVLVGSVGGTIPNHPLNSLGNGNQLVWKRKAEQYLADSGVPYTIIRAGGLEEKPGGLRELLVGKDDELLQQPELVVVSRADVAEVCIQALQFEEAKFKAFDLGSKPEGIGSPTKDFRDLFSQVTSRF

SEQ ID NO: 1484 - protein, 269 aa, Argemone mexicana
MANSSEKLTVLVTGASGLTGHLAFKKLKERSDKFVVRGLVRSEASKQKLGGGDDIFIGDVMDPKSLEPAMHGIDALIILTSAIPKIKPGSLPGADGKRAEDVIDSSFDGPMPEFYYEEGQYPEQVDWIGQKNQIDTAKACGVKHIVLVGSMGGSDPNHFLNYMGNGNILIWKRKAEQYLADSGIPYTIIRAGGLDNKEGGRELLVGKDDELLPTENGYISRADVAEACVQALQIENVKFKAFDLGSKPEGVGEPTKDFKALFASVTTPF

SEQ ID NO: 1485 - protein, 251 aa, Argemone mexicana
MASTVIVTGAGGRTGQIVYKKLKERSDQYLARGLVRTEESKEKIGGADDVFVGDIRDAESILPAIKGVDALIILTSAVPKMKPGFDPSKGGKPEFYFEDGAYPEQVDWIGQKNQIDAGKAAEVKHIVLVGSMGGTNLNNPLNSIGNGNILIWKRKAEQYLADSGIPYTIIRAGGLQDKEGGIRELVVGKDDELVQTEIRTITRADVAEVCIQALQFEEAKFKALDLASKPEGTGEPTKDFKTLFSQISTRF

SEQ ID NO: 1486 - protein, 251 aa, Argemone mexicana
MASTVIVTGAGGRTGQIVYKKLKERTDQYVARGLVRTEESKEKIGGADDVFVGDIRDAESIAPAIQGVDALVILTSAVPKMKPGFDPSKGGRPEFYFEDGAYPEQVDWIGQKNQIDAAKAAGVKQIVLVGSMGGTNLNHPLNSLGNGNILVWKRKAKQYLADSGVPYTIIRAGGLQDKEGGLRELVVGKDDELLQTDIRTIARADVAEVCIQALQFEEAKFKAFDLASKPEGCGEPTKDFKTLFSQISTRF

SEQ ID NO: 1487 - protein, 253 aa, Berberis thunbergii
MANSQTVLVTGAAGRTGQIVYKKLKERSDQYVARGLVRTEESKEKIGGKDDVFVGDIRDAGSIVPAIQGIDALIILTSAVPKMKPGFDPTKGGRPEFYYEEGAMPEQVDWIGQKNQIDAAKAVGVKQIVLVGSMGGTNPDNPLNKIGDGNILVWKRKAEQYLADSGIPYTIIRSGGLQDKEGGVRELIVAKDDELVATDTRSIPRADVAEVCIQALQFEEAKFKAFDLASKPEGAGEPTKDFKALFSKITTRF

SEQ ID NO: 1488 - protein, 269 aa, Corydalis chelanthifolia
MATCSQKKTVLVTGASGLTGQIVYKKLKERSDEFVVRGLVRSEASKQKLGGGDDIYIGDINKPETLVPALEGVDALIIVTSAIPKIVPGSCAVAGERAEDVIDSSFEGPMPDFYYEEGQYPEQVDWIGQKNQVDAAKAAGVKHVVLVASMGGLDPNHFLNYMGNGMILIWKRKAEQYLADSGLPYTIIRSGGLDNKAGGRELLVEKDDVLLPTESGYIARADVAETCVQAVRHEDLTKFKAFDLGSKPEGTGTPTKDFRALFAPITTTF

SEQ ID NO: 1489 - protein, 278 aa, Corydalis chelanthifolia
MACKTCCSKIPCFRQKKTVLVTGAAGLTGNMVYKKLKERSDLFVARGLVRSEGSKKKIGGHDDVFIGDVMDPKSLAPAMKGIDALVILTSAVPKIKPGSGPNTGKRAEDVIDSSFQGPMPEFYFEEGQYPEQVDWIGQKNQIDAAKAAGVKHIVLVGSMGGCDPNHFLNSLGNGNILVWKRKSEQYLADSGVPYTIIRAGGLENKAGGRELLVGKNDELLPTEAGYISRADVAEACVQAVQFEEVTKFKAFDLGSKPEGTGTPTKDFKALFSLVTARF

SEQ ID NO: 1490 - protein, 272 aa, Corydalis chelanthifolia
MVTCSCTQKKTVLVTGASGLTGSIVYKKLKERSDKFVVKGLVRSEASKQKIGGGDDDVCFGDIMKPETLIPAMEGVDALIILSSAVPKIVPGTCAIAGERAEDVIDSSFEGPMPDFYYEEGQYPEQVDWIGQKNQVDAAKAAGVKHVVLVASMGGMDPNHFLNYMGNGMILIWKRKAEQYLADSGLPYTIIRAGGLDNKVGGRELVVGKEDELLPTESAYIARADVAEACIQALQFEEYVKFKAFDLGSKPEGMGTPTTDFGALFTPITTTF

SEQ ID NO: 1491 - protein, 275 aa, Corydalis chelanthifolia
MAESDRKTTVLLTGAAGATGKFVFKKLKERSEKYVVRGLVRSIESKKKLGENVNDDDVYLGDIQKPETLIPALQGVDALIILTSAIAKVKPGQNPTRGDRAENYFNEDGSLAEDMPEFHFPPGSIPEEVDWIGQKNQIDAAITAGVKHIIVVGSICGTIPEHPLNTIGNGDILLWKRKAEKYLTESGVPYTIIRAGALDDKEGGVRELLVGKDDEVVYQMENIYISRDDVAETCIQALQFEEAKFKAFDLTSKPEGTGTPTKDFKALFSQATARF

SEQ ID NO: 1492 - protein, 270 aa, Corydalis chelanthifolia
MDDSYRKTVLVTGASGATGQIAYNKLKERPEQFVARGFVRSEASKKKIGGGDNVFLGNVMDADSIIPAVEGIDALIILTSAIPKMKPGVGFSNEGERAEDVIDGSFEGPMPEFYFEEGQFPEQIDWIGQRNQIDAAKAAGVKHIVLVGSMGGSDPNHPLNTLGNGNILVWKRKAEQYLADSGVPYTIIRAGGLINKPGGLRELLIGKNDELLPTESGYVPREDVAEVCVQALQFEEYVKFKAFDLGSKPEGTGTPTKDFKALFSQVTRRF

SEQ ID NO: 1493 - protein, 269 aa, Chelidonium majus
MEGSSQKITVLVTGASGLTGNLAFSKLKERSDKFVVRGLVRSEASKQKLGGGDEIYIGDIKDAESLVPAMTGIDGLIILTSAIPKIVPGSMPDTEGKRSEDVIDGSFEGPMPEFYYDEGQYPEQVDWIGQKNQIDTAKSLGVKHVVLVASMGGQDPNHFLNYMGNGNILIWKRKAEQYLADSGLPYTIIRAGGLDNKQGGRELLVDKDDVLLPTENGYIARADVAEACVQALQCEETKFKAFDLGSKPEGTGTPTTDFKALFAPITTSF

SEQ ID NO: 1494 - protein, 282 aa, Chelidonium majus
MACKSCCSKVLTACSTPKKTVLVTGASGLTGRFAFNKLKERPDKYVARGLVRSEASKQKLGGGDEIYIGDVMDQKSLEPAMKGVDALIILTSATPKMVPGQFPEGSGERGEDLIDGSFEGPMPEFYFDEGQTPERVDWIGQKNQIHAAKAAGVKHIILVSSMGSGDPNHPLNSLGNGNILAWKRKSEEYLANSGVPYTIIRAGGLDNKDGGKRELLVGKNDELLPTEKGYIARADVAEACVQAVLFFDELKNKAFDLGSMPEGTSTPTKDFKALFAPITTSF

SEQ ID NO: 1495 - protein, 267 aa, Chelidonium majus
MDDSRRKTVLVTGASGATGKLAYDKLKERPDQFVARGFVRSENSRKKIGGGDGVFIGDVQNAESIVPAVQGIDALIILTSAIPKIKPGVVPDEGQKAEKYIDSSFESMPEFYYDEGQYPEQVDWIGQKNQIDAARAAGVKHIILVSSMGSGDPNHPLNSLGNGNILIWKRKAEQYLADSGVPYTIIRAGGLIDNPGGMRELLIGRNDELLPTEDGYVPRADVAEVCVQATQFEETKFKAFDLGSKPEGKGTPTKDFKALFSKLTDRF

SEQ ID NO: 1496 - protein, 270 aa, Chelidonium majus
MADSDRKKILVTGAAGSTGNLAYKKLKERTEKYVARGLVRSEESKKRIGGADDVFIGNIRDAQTLVPAVEGIDGLIILTSSLLKIRPGSAAPKGDKAEYYMLEDGSFDPDMPEFYYEESPEQVDWIGQKNQIDAAKAAGVKHIVLVGSMGGTDPNQPLNSLGDNGNFLIWKRKSEQYLADSGIPYTIIRCGGLDDKEGGKRELLVSKDDEMFSQIELIYISRDDVAEVCIQAFECEEAKFKAFDLTSKPEGTGTPTRDFKALFAQVTTRF

SEQ ID NO: 1497 - protein, 271 aa, Chelidonium majus
MDNSDRKTVLVTGASGVTGNLAYKKLMQRTDKYVGRGFVRSEASKEKIGGTDNVFIGNINDPQTLVPAVQGIDALIILTSSMLKIKPGSAAPKGDKPDNYFNEDGSFDPDMPEFYYEDGNSPEEVDWIGQKNQIDAAKAAGVKHIVLVGTMCGTFPNHPVNILGNGNMLVWKRKSEQYLADSGIPYTIIRAGGLDDKEGGLREIVFSKDDEMFADINMIYISRDDVAEVCIQALECDDAKFKAFDLTSNPEGTGTPTTDLKALFSQVTTRF

SEQ ID NO: 1498 - protein, 270 aa, Chelidonium majus
MDDSRRKTVLVTGASGATGKLAYDKLKERPDQFVARGFVRSENSRKKIGGGDGVFIGDVQNAESIVPAVQGIDALMILTSAVPKIKPEFLIPTKGERAENYVTEGASFESVPEFYYDEGQFPEQVDWIGQKNQIDVARAAGVKHIILVGSVGGTDPNHPLNSLGNGNILIWKRKAEQYLADSGVPYTIIRAGGLLDSPGGMRELRIGRNDELLKTEDGSVPREDVADVCVQATQFEETKFKAFDLGSKPEGKGTPTKDFKALFSQLTDRF

SEQ ID NO: 1499 - protein, 269 aa, Chelidonium majus
MAESQKKMTVLVTGASGLTGQLAFKKLKERSDKFVVRGLVRSEASKQKLGGGDEIFIGDILNEESLVPAMTGIDGLIILTSAIPRIVPGSMPDTEGKRAEDVVDGSFEGPMPEFYYEEGQYPEQVDWIGQKNQIDTAKSLGVKHIVLIGSMGGQDPNHFLNYMGNGNILIWKRKAEQYLADSGVPYTIIRAGGLDNKEGGRQLLVGQNDELLPTEDGYIARADVAEACIQALQIEESKFKALDLGSKPEGVGELTKDFKPLFASVTTRF

SEQ ID NO: 1500 - protein, 255 aa, Cissampelos mucronata
MADLPRTTVLVTGAGGRTGQIVYKKLKERRDQYAARGLVRTEESKEKIGGADDVFVGDIREAERIVPAIQGIDALIILTSAVPKMKPGLDPSKGGRPEFYFEDGAFPEQVDWIGQKNQIDAAKDAGVKQIVLVGSMGGTNPNHPLNSIGNGNILVWKRKAEQYLADSGVPYTIIRAGGLQDKEGGVRELLISKDDELLSTETRTIARADVAEVCIQALQYEESKFKAFDLASKPEGTGEPTKDFKALFSKITTRF

SEQ ID NO: 1501 - protein, 273 aa, Eschscholzia californica
MADSSKKLTVLVSGASGLTGSLAFKKLKERSDKFEVRGLVRSEASKQKLGGGDEIFIGDISDPKTLEPAMEGIDALIILTSAIPRMKPTEEFTAEMISGGRSEDVIDASFSGPMPEFYYDEGQYPEQVDWIGQKNQIDTAKKMGVKHIVLVGSMGGCDPDHFLNHMGNGNILIWKRKAEQYLADSGVPYTIIRAGGLDNKAGGVRELLVAKDDVLLPTENGFIARADVAEACVQALEIEEVKNKAFDLGSKPEGVGEATKDFKALFSQVTTPF

SEQ ID NO: 1502 - protein, 273 aa, Eschscholzia californica
MEGSCQKITVLVTGASGLTGQLAYKKLKERSEQFEVRGLVRSEASKQKLGGGNEIFIGDIMDAKTLEPAMKGIDALIILTSAIPKMKPSDEFPAESCSTGRAEDMIDGSFDGPMPEFYFEDGQYPEQVDWIGQKNQIDTAKALGVKHIVLVGSMGGSDPNHFLNSLGNGNILIWKRKAEKYLADSGLAYTIIRAGGLDNKEGGIRELLIGKDDVLLPTENGYIARADVAEACIQALKIEEVKFKAFDLGSKPEGTGVPTKDFGALFSPITERF

SEQ ID NO: 1503 - protein, 273 aa, Eschscholzia californica
MEGSCQKMTVLVTGASGLTGQLAYKKLKERSEQFVVRGLVRSEASKQKLGGGDDIFIGDIMNCQTLEQAMKGIDGLIILTSAIPKMKPTDEFPAESLGSGRAEDMIDGSFDGPMPEFYFEEGQYPEQVDWIGQKNQIDTAKALGVKHVVLVGSMGGSDPKHFLNSLGNGNILIWKRKAEQYLADSGLAYTIIRAGGLDNKEGGIRELLVGKDDLLLPTENGYIARADVAEACVQALQFENVKFKAFDLGSKPEGNGEPTKDFGALFAPISERF

SEQ ID NO: 1504 - protein, 284 aa, Eschscholzia californica
MACKTSCSKLMATCCSSKKTVLVTGASGLTGQFAFNKLKERSDKFVVRGLVRSEGSKKKLGGGDEIYIGNVMDPKTLEPAMKGVDALIILTSAIPKMKPGQFPENSNGGGRAEDMIDGSFEGPMPEFYFDEGQFPEQVDWIGQKNQIDVAKACGVKHIVLISSMGSGDPNHPLNSLGNGNILAWKRKSEEYLSNCGVPYTIIRAGGLDNKDGGIRQLLVGKNDELLPTEKGYIARADVAEACVQAVQFEELVKFKAFDLGSMPEGTGTPTKDFKALFTPITARF

SEQ ID NO: 1505 - protein, 267 aa, Eschscholzia californica
MDDSRPKTVLVTGASGATGQIAYNKLKERPEQFIARGFVRSEQSKKKIGGGDDVFLGNIMDSNTIVPAVQGIDALIILTSAIPKIKPGVFPNEGEKAEKYIDSSFESMPEFYFDEGQYPEQIDWIGQKNQIDAARAAGVKHIILVGSVGGSDPNHPLNSLGNGNILVWKRKAEEYLAESGVPYTIIRAGGLIDNPGGMRELLVGKDDEFLPTENGYVPRADVAEVCVQAVKFEEAKFKTFDLGSKPEGKGKPTTDFKALFSQVTTRF

SEQ ID NO: 1506 - protein, 279 aa, Eschscholzia californica
MAASDLGGKKTVLVTGAAGLTGRLVFKKLKERSDKYVVRGLVRSEESKKKIGSGLSDDEEEIFIGDIKDSQTLIPAMKGIDALIILTSALPKVKPGPAANRGDRAEYYVNEDGSFPDPMPEIYYEQGNYPEQVDWIGQKNQIDTAIAAGVKQIVLIGSMCGTDPDNFLNKYGNGNILVWKRKSEKYLSESGVPHTIIRAGGLDDLEGGLRELQVSKDDEMMAHIENIMISRADVAEVAVQALEHEEAKFKAFDLTSKPVGTGTPNKDFKALFAQTTVPF

SEQ ID NO: 1507 - protein, 269 aa, Glaucium flavum
MAESQEKMTVLVTGASGLTGQLAFKKLKERSDKFVVRGLVRSEASKQKLGGGDDIFIGDILNAESLVPAMTGIDGLIILTSAIPKIVPGSFPDTDGKRAEDVVDGSFEGPMPDFYYEEGQYPEQVDWIGQKNQIDTAKSLGVKHIVLIASMGGQDPNHFLNYMGNGNILIWKRKAEQYLADCGVPYTIIRAGGLDNKEGGRELLVGRNDELLPTENGYISRADVAEACVQALQIEESKFKALDLGSKPEGVGEPTKDFKSLFASVTDRF

SEQ ID NO: 1508 - protein, 269 aa, Glaucium flavum
MDSSSQKMTVLVTGASGLTGSLAYNKLKERSDKFVVRGLVRSEASKQKLGGGDDIFIGDIMNAESLVPAMTGVDGLIILTSAVPKIVPGSFPNADGKRAEDVLDGAFDGPMPDFYYEEGQLPEQVDWIGQKNQIDTAKALGVKHVVLIGSMGGQDPNHFLNYMGNGMILIWKRKAEQYLADSGLPYTIIRAGGLDNKQGGRELLVDKDDVLLPTENGYIARADVAEACIQALQCEETKFKAFDLGSKPEGTGTPTTDFKALFAPITARF

SEQ ID NO: 1509 - protein, 280 aa, Glaucium flavum
MACKSCCSKLVAACSSKKTVLVTGASGLTGQFAFNKLKERSDKYVVRGLVRSEGSKKKLGGGDEIYIGNVMDQKSLEPAMKGVDALIILTSAIPKMKPGQFPEGSGGRAEDMIDGSFEGPMPEFYFDEGQYPEQVDWIGQKNQIEAAKAAGVKHIILVSSMGSGDPNHPLNSLGNGNILAWKRKAEEYLAGSGVPYTIIRAGGLDNKQGGIRELLVGKNDELLPTEKGYIAREDVAEACVQAVLYDEVKFKAFDLGSMPEGTGTPTKDFKALFAPITTSF

SEQ ID NO: 1510 - protein, 267 aa, Glaucium flavum
MDDSRRKTVLVTGASGATGQIAYNKLKERPDQFIARGFVRSENSKQKIGCGEGVFIGDIQKAESIVPAVQGIDALIILTSAIPKIKPGLVPDKGEKAEKYIDGSFESMPEFYFDEGQYPEQVDWIGQKNQIDAARAAGVKHIILVGSAGGTDPNHPLNSLGNGNILIWKRKAEQYLAESGVPYTIIRAGGLIDNPGGMRELVVGRNDELLPTENGYVPRADVAEVCVQATQFEEAKFKAFDLGSKPEGKGTPTKDFKALFSQVSDRF

SEQ ID NO: 1511 - protein, 271 aa, Glaucium flavum
MVESGRKTVLVTGAAGLTGKLAYKKLKERTEKYVGRGFVRSEESKKRIGGADDVFIGNIKDAQTLIPAVQGIHGLIILTSCSAKVKPGCAAPKGDRPENYILEDGSLDPDIPEFYFEDGASPEEVDWIGQKNQIDAAKAAGVKHIVLVGGMGGMDPYSPLSNFGNGNVLVWKRKAEQYLADSGIPYTIIRAGGLEDKEGGRRELLVSKDDEMFSQMEMAYISRDDVAEVCIQALECEEAKFKAFDLTSKPEGTGKPTRDFKALFSQVTTRF

SEQ ID NO: 1512 - protein, 270 aa, Glaucium flavum
MVGLLRRTVLVTGAAGLTGQIVYNKLRERVTQYIPRALVRSEERKRKIGGSDDVFIGDITDAKSIIPAIQGIDALIVLTSAVPKIKPGYVPTKGERAENYIEDDGSFDEMPEFYFEDGGEPEQVDWIGQRNQIDAAKAAGVKQIVLVGSMCGTIPNHPLNSLGNGNILVWKRKAEQYLADSGVPYTIIRAGGLEDKAGGLRELIVGQDDDLLQQPVLADITRADVAEVCIQALQFEEAKFKAFDLGSKPEGTGFPTNDFKALFCQVTAHF

SEQ ID NO: 1513 - protein, 253 aa, Jeffersonia diphylla
MATLPTVLVTGAGGRTGQIVYKKLKEKVDQYVARGLVRTEESKEKIGGADDVFVGNITDAESIVPAFQGIDALIILTSAVPKMKPGFDPSKGGRPEFYFEDGAYPEQVDWIGQKNQIDAAKAVGVKQIVLVGSMGGTNLDNPLNSLGNGKILVWKRKAEQYLADSGIPYTIIRSGGLQDKEGGVRELLVGKDDELVKTDTRTIARADVAEVCVQALQFEEAKFKAFDLASKPEGTGEPTKDFKGLFSKITTTF

SEQ ID NO: 1514 - protein, 253 aa, Mahonia aquifolium
MADLQTVLVTGAAGRTGQIVYKKLKERSDQYVARGLVRTEESKEKIGGKDDVFVGDIRDAGSIVPAVQGIDALIILTSAVPKMKPGFDPTKGGRPEFYFEEGAMPEQVDWIGQKNQIDAAKAVGVKQIVLVGSMGGTNPDNPLNKIGDGNILVWKRKAEQYLADSGIPYTIIRAGGLQDKEGGVRELIVAKDDELVTTDTRSIPRADVAEVCIQALQFEEAKFKAFDLASKPEGAGEPTKDFKALFSKITTRF

SEQ ID NO: 1515 - protein, 255 aa, Menispermum canadense
MANLTRITVLVTGAGGRTGQIVYRKLKERADQYLARGLVRTEESKDKIGGADDVFVGDIRDAESIYPVIQGIDALIILSSAVPKMKPGYDPSTGGRPEFIFEDGANPEQVDWIGQKNQIDAAKDAGVKQIVLVGSVGGTNPNYSLNSMGNGNILVWKRKAEQYLADSGIPYTIIRAGGLQDKEGGVRELLVGKDDELLNTETIKIARADVAEVCIQALQFEEAKYKAFDLASKPEGTGEPTRNFKALFSQITSRF

SEQ ID NO: 1516 - protein, 253 aa, Nandina domestica
MAGLPTVLVTGAGGRTGQIVYKKLKERADQYAARGLVRTEESKEKIGAADDVFVGDIRDASSIVPAIQGIDALIILTSAVPKMKPGFDPSKGGRPEFYYEDGAFPEQVDWIGQKNQIDAAKAVGVKQIVLVGSMGGTNLDHPLNNIGNGKILVWKRKAEQYLADSGIPYTIIRAAGLQDKEGGVRELVVGKDDELLQTETRAIARADVAEVCIQALQFEEAKFKAFDLASKPEGTGQPTKDFKALFSKITTRF

SEQ ID NO: 1517 - protein, 256 aa, Nigella sativa
MAADSSRSTVLVTGAGGRTGQIVYKKLKEKTDQYVARGLVRTEESKEKIGGADDVFVGDIRDAESLAPAIEGIDALVILTSAVPKMKPGFDPSKGGRPEFYFEDGAFPEQVDWIGQKHQIDAAKAAGVKQIVLVGSMGGTNLNHPLNSIGNGNILVWKRKAEQYLADSGIPYTIIRAGGLQDKEGGLRELIVSKDDELLQTETRTIARADVAEVCVQALQFEEAKFKAFDLASKPEGTGEPTKDFKSLFSQIVSRF

SEQ ID NO: 1518 - protein, 251 aa, Papaver bracteatum
MASTVIVTGAGGRTGQIVYKKLKERTDEFVARGLVRTEESKEKIGGADDVFVADIRDAESIVPAIQGADALVILTSAVPKMKPGFDPTKGGRPEFFFEDGANPEQVDWIGQKNQIDAAKAAGVKQIVLVGSMGGTNLNHPLNSIGNGNILVWKRKAEQYLADSGIPYTIIRAGGLQDKDGGVRELVVGKDDELLETDIRTIARADVAEVCIQALLLEEAKFKALDLASKPEGTGEPTKDFKTLFSQISTRF

SEQ ID NO: 1519 - protein, 271 aa, Papaver bracteatum
MAESNQKITVLVTGASGLTGEIAFKKLKERSDKFVVRGLVRSEASKQRLGGGDEIFLGDVMDKKSLETAMQGIDALIILTSAVPKIVPGSYPGADGKRAEDVFGESFDFNGPMPEFYYEEGQYPEQIDWIGQKNQIDTAKSCGVKHIVLVGSMGGTDPNNFLNHMANGNILVWKRKAEQYLADSGIPYTIIRAGGLDNKVGGRELLVGKDDELLSTENHFIARADVAEACVQALQIEESKFKAFDLGSMPEGVGEPTKDFKALFAPITTRF

SEQ ID NO: 1520 - protein, 270 aa, Sanguinaria canadensis
MADSRQKLTVLVTGASGLTGQIAFKKLKERSDQFVVRGLVRSEASKQKLGGGDEIYIGDVMNAESLVPAMTGIDALIILTSAIPKIKPSESFPVVEGQRSEDVVDGSFSGPMPEFYYEEGQYPEQVDWIGQKNQIDTAKALGVKHIVLVGSVGGTDPNHFLNSMGNGNILIWKRKAEQYLADSGIPYTIIRAGGLDNKEGGRELIVGKDDELLSTENGYIARADVAEACVQALQIEEAKCKALDLMSKPEGVGEPTKDFKGLFASVTTRF

SEQ ID NO: 1521 - protein, 271 aa, Sanguinaria canadensis
MADSRQKFTVLVTGASGLTGHFAFKKLKERSDQFVVRGLVRSEASKQKLGGGDQIYIGDVMNAESLVPAMTGIDALIILTSAIPKIKADESFPVAEGQRAEDVIDETFSGPMPEFYYEEGQYPEQVDWIGQKNQIDTAKALGVKHVVLVASMGGQDPNHFLNYMGNGNILIWKRKAEQYLADSGLPYTIIRAGGLDNKQGGIRELLVDKDDVLLPTANGYIARADVAEACVQALHCEEVKFKAFDLGSKPEGTGTPTKDFKALFAPITTSF

SEQ ID NO: 1522 - protein, 282 aa, Sanguinaria canadensis
MACKSCCSKIMACSTPKKTVLVTGASGLTGQFAFNKLKERSDKFVARGLVRSEGSKKKLGGGDEIYIGDVMDQKSLEPAMKGIDALIILTSAIPKMKPGQFPEGGGGGGRAEDLIDGSFEGPMPEFYFEEGQYPERVDWIGQKNQIDAAKAAGVKHIVLISSMGSGDPNHPLNSLGNGNILAWKRKSEEYLANSGVPYTIIRAGGLDNKEGGIRELLVGKNDELLPTEKGYIARADVAEACVQAVLFEEVKFKAFDLGSMPEGTGTPTKDFKALFAPITTHF

SEQ ID NO: 1523 - protein, 267 aa, Sanguinaria canadensis
MDDSRRKTVLVTGASGATGQIAYNKLKERPDQFVARGFVRSEHSKQKIGGGDGVFIGDILDPESIAPAVQGIDALIILTSAIPKIKPGQFPDTGGKAESYISQSFESMPEFYFEEGQYPEQVDWIGQKNQIDAAKAAGVKHIVLLGSMGGTDPNHPLNVLGNGNILIWKRKSEKYLADSGLPYTIMRAGGLIDNPGGMRELLVGRNDELLPTENGFVPRADVAEVCVQALLFEEAKFKAFDLASKPEGKGTPTKDFKALFSQVTDRF

SEQ ID NO: 1524 - protein, 271 aa, Sanguinaria canadensis
MARLLQSTVLVTGAAGLTGQIVYKKLRERATQYIPRGLVRSEERKKKIGGSDDVFIGDITDAKSIIPAVQGIDALIILTSAIPKIKPGFIVPTKGERAENYIGEDGSFDEMPEFYFKDGGSPEQVDWIGQKNQIDAAKGAGVKQIVLVGSMCGTIPNHPLNNLGNGNILVWKRKAEQYLADSGVPYTIIRAGGLGDKPGGLRELLVGKDDELLQQPELVDVSRADVAEVCIQALQFEEAKFKAFDLGSKPEGTGTPTNDFKALFSQVSTTF

SEQ ID NO: 1525 - protein, 270 aa, Stylophorum diphyllum
MADSDRKTILVTGAAGSTGNLAYKKLKERTEKYVARGLVRSEESKKRIGGADDVFIGNIRDAQTLVPAVEGIDGLIILTSSLLKIRPGSAAPKGDKAEYYFLEDGSLDPDMPEFYYEESPEQVDWIGQKNQIDAAKAAGVKHIVLVGSMGGTDPNHPLNILGDNGNFLIWKRKAEQYLADSGIPYTIIRCGGLDDKEGGKRELLVSKDDEMFSQIELIYISREDVAEVCIQAFECEEAKFKAFDLTSKPEGTGTPTRDFKALFAQVTTRF

SEQ ID NO: 1526 - protein, 269 aa, Stylophorum diphyllum
MAESQQKMTVLVTGASGLTGQLAFKKLKERSDKFVVRGLVRSEASKQKLGGGDEIFIGDILNTESLVPAMTGIDGLIILTSAIPRIVPGSMPDTEGKRAEDVVDGSFEGPMPEFYYEEGQYPEQVDWIGQKNQIDTAKSLGVKHIVLIGSMGGQDPNHFLNYMGNGNILIWKRKAEQYLADCGVPYTIIRAGGLDNKEGGRQLLVGQNDELLPTEDGYISRTDVAEACIQALQIEESKFKALDLGSKPEGVGEPTKDFKPLFASVTTRF

SEQ ID NO: 1527 - protein, 267 aa, Stylophorum diphyllum
MDDSRRKTVLVTGASGATGKLAYDKLKERPDQFIAKGFVRSENSRKKIGGGDGVFIGDVQNAESIVPAVQGIDALIILTSAIPKIKPGLVPDEGQKAEKYIDSSFESMPEFYYDEGQYPEQVDWIGQKNQIDAARAAGVKHIILVSSMGSGDPNHPLNSLGNGNILIWKRKAEQYLADSGVPYTIIRAGGLIDNPGGMRELLIGRNDELLPTEDGYVPRADVAEVCVQATQFEETKFKAFDLGSKPEGKGTPTKDFKALFSKLTDRF

SEQ ID NO: 1528 - protein, 271 aa, Stylophorum diphyllum
MANSDRKTVLVTGASGVTGNLAYKKLMERTDKYVGRGFVRSEASKEKIGGTDNVFIGNISDPQTLVPAVQGIDALIILTSSMLKIKPGSAAPKGVKPDDYFNEDGSFDPDMPEFYYEDGNSPEEVDWIGQKNQIDAAKAAGVKHIVLVGSMCGTYPNHPVNILGNGNMLVWKRKSEQYLADSGIPYTIIRAGGLDDKEGGLREIVFSKDDEMFADMNMIYISRDDVAEVCIQALECEDAKFKAFDLTSNPEGTGTPTTNLKALFSQVTTRF

SEQ ID NO: 1529 - protein, 255 aa, Stylophorum diphyllum
MAESNRSTVLVTGAGGRTGQLVYKKLKERSSEYIARGLVRSEESKSKIGGANDVFIGDVTKPETLAPAIEGIDALVILTSGVPKMKPGFDPTKGGRPEFYFEDGQYPEQVDWEGQKSQIDAAKAAGVKQIVLVGSMGGTNLNHPLNSLGNGNILVWKRKAEQYLADSGIPYTIIRAGGLQDKEGGIRELLIGKDDELLQTETKTVARPDVAEVCVQALQIEEAKFKAFDLASKPEGTGTPTKDFKALFSQITTRF

SEQ ID NO: 1530 - protein, 250 aa, Stylophorum diphyllum
MTTIIVTGAGGRTGQIVYKKLKERTDQYVARGLVRTEESKEKIGGADDVFVGDIRDADSIVPAIQGADALVILTSAVPKMKPGFDPTKGGRPEFYFEEGAYPEQVDWIGQKNQIDAAKAAGVKQIVLVGSMGGTNPNHPLNSIGNGNILVWKRKAEQYLADSGIPYTIIRAGGLQDKEGGVRELVVGKDDELLETEIRTIARADVAEVCIQALQIEEAKFKALDLASKPEGTGEPTKDFKSLFPQVSTRF

SEQ ID NO: 1531 - protein, 255 aa, Tinospora cordifolia
MADLPRTTVLVTGAGGRTGQIVYKKLKERADQYVGRGLVRTEESKEKIGGADDVFVGDIRDAESILPAIQGIDALIILTSAVPKMKPGFDPSKGGRPEFYFEEGSYPEQVDWIGQKNQIEAAKNAGVKQIVLVGSMGGTNPNHPLNSLGNGNILVWKRKAEQYLADSGIPYTIIRAGGLQDKEGGVRELLVGKDDELLQLDTRSIAREDVAEVCIQALQFEEAKFKAFDLASKPEGAGEPTKDFKALFSKISTRF

SEQ ID NO: 1532 - protein, 255 aa, Thalictrum flavum
MSATDRSTVLVTGAAGRTGQIVYKKLKERVDQYVARGLVRTEESKEKIGGADDVFLGDIRDAGSITPAIQGIDALVILTSGVPKMKPGFDPSKGGRPEFYFEEGAYPEQVDWIGQKNQIDAAKEAGVKQIVLVGSMGGTNLNHPLNSLGNGNILVWKRKAEQYLADSGIPYTIIRAGGLQDKEGGLRELIVGKDDELLQTETRSITRADVAEVCIQALQFEEAKFKAFDLASKPEGTGEPTRDFKALFSQVATRF

SEQ ID NO: 1533 - protein, 252 aa, Xanthoriza simplicissima
MAPSTVLVTGAGGRTGQLVYKKLKERVDQYVARGLVRTEESKEKIGGADDVFVGDIRDTASIAPAIQGIDALVILTSAVPKMKPGFDPSKGGRPEFFFEDGAYPEQVDWIGQKNQIDSAKAAGVKQIVLVGSMGGTNPNHPLNSLGNANILVWKRKAEQYLADSGIPYTIIRAGGLQDKEGGLRELIVGKDDELLQTETRGIPRAEVAEVCIQALQFEEAKFKALDLASKPEGTGEPTKDFKALFSQVTTRF

SEQ ID NO: 1534 - protein, 356 aa, Argemone mexicana
MGVNDKQDQNQEVDIKDQAHLWNIIYGFADSLVLRCAVEIGIADIIKNNNGSISVSELASKLPISNVNSDNLYRILRYLVHMSILKEETSSDINGGNKLYSLQPVGTLLLRDAERSMVPMILGMTQKDFMIPWHFMKEGLGNGETAFEKGMGMTIWEYLEGHPDQSQLFNEGMAGETRLLTKSLINGCRDIFEGLNSLVDVGGGNGTTIRAIYNAFPHIKCKLYDLPHVIANSLDQPNIECIPGDMFKFVPTAQAILLKLILHDWTDEECVNILKKCKEAIPKETGKVIIVDVALEEESKHELTKTRLILDIDMLVNTGGRERTADDWENLLKRAGFRSHKIRSIAAIQSVIEAYP

SEQ ID NO: 1535 - protein, 357 aa, Argemone mexicana
MEVNKIDQENQSKIWKQIYGFADSLVLKCAVQLEIAETIHNHGKPMSLSELASKLPIQPINLDRLYRVMRYLVHMKLFNKEIITINGDINNTETVIKYSLAPPAKYLIRGWEKSMVASILAINDKDFLAPWHHLKEGLTGNCDAFEKALGKSIWVFMSENPEKNKLFNEAMACDTRLVTSALVNECKNIFCDDGIKTLVDVGGGTGTAMKAISKAFPNINCTIYDLPHVIADSPEIPNITKIAGDMFKSIPSADAILMKCILHDWDDEECIKILKLCKEAVPRKGGKVIIVDVVLNMDMTHPYSKIRLTLDLDMMLNTGGKERTEEEWKKLFDAAGFATYKITQISAVQSVIEAYPY

SEQ ID NO: 1536 - protein, 316 aa, Argemone mexicana
MEVKKSDQALQAKTWKIIYGFAESQVLKCAVELDIASTIHNHGQPMTLSELASKLPVQQPINSDHLYRVMRYLVHMKLFTSINGDVIRYGLEPPAKYLIKVWEKSMVPSILSLQDNVLFTPWNHLKDAMTGNSNAFEKVFGKSIWEYMSEHPDKNKIFNESMACNSRFLISALVNDCKSVFEGLNTLVDVGGGTGTTAKAISKAFPYIKCTVYDLPHVIADSPSDPDIVYVPGDMFKFIPSADAVLLKWILHDWDDKECIQILKLCKEVVPREGGKIIIVDIVLNTKNSNEHPYTKMRLRFDLGMMLKTGGKERTE

SEQ ID NO: 1537 - protein, 357 aa, Argemone mexicana
MEIKLEDQEQEMKYQGQVWNLICGNVDSSVLKCTIELGLLDIIHQNSKKPITLIELSSSSKSLSSLKTQNLYRLLRYLSHMNLITINSKEEGKDETFSLTDLSNLLLSNQERSLKDWVLGIDDEHSINVWHELSSYCSSPEDAPTPFVKLNGKTLWELAEEIPEVNQLINNGMASDTKMVMPAFVEGCGKILNEIKELVDIGGGTGAAMGYVVRAFPHIKCTVFDLPHVVATAPKIPGVEMIGGDMFEFIPPADALLLKFMLHNWKDEECIKLLKKCKETIPVDEGKVVIVEMVLDQDEDDHDLTQARLSLDLDMMLSSGGKERTKEEWRILLKKAGFNKIEFIPIFAIQSVIVAYP

SEQ ID NO: 1538 - protein, 366 aa, Argemone mexicana
MNTTTELIPPTLQVNDEEEAAACMFAMQLASASVLPMVLKSAIELNLLEAIAKAGPGAYVSPSELAAGLPSSQPDTPVMLDRILRLLASYSVLKCELRDLPHGRVERLYGLAPVCKFLTKNSDGVSMAPLLLMNQDKILMESWYHLKDAVVDGGIPFNKAYGMTAFEYHGKDPRFNKVFNQGMSNHSTITMKKILETYNGFAGLNTLVDVGGGTGATLNMIISKYPNLKGINFDLPHVVEDAPSYPGVEHVGGDMFVSVPKGDAIFMKWICHDWSDAHCLAFLKNCYKALPNNGKVILAECILPEAPDSELTTKNVIHIDVIMLAHNPGGKERTEKDFEALGKEAGFRSFNKACCAYNTWIIEYYK

SEQ ID NO: 1539 - protein, 368 aa, Argemone mexicana
MGSNHQNEINKSSKEEEEEKACMYALQLASASVPVMVLRAVIELDVLEIIAKAGEGVELSAAYIASQIPNIKNPNASVMLDRMLRLLSSYKILTCSIRDLDDGSVERAYGLELVCKFLVKNEDGVSMASLLLMNQDKVFLESWYHLKDAVLSGGIPFNMAYGMNAFEYQATDPRFNKIFNKGMSDHTTICMKKILETYKGFEGLNSIIDVGGGIGVTLNMIVTKYPTIKGINFDLPHVIKDAPTYPGVEHVGGDMFVSIPKGTDAIFMKWILHDWSDESSIKILKNCYEALPKHGKLILVECIIPATTEPSLEGLGVFHVDNIMMAYNPGGKERTEKEFETLAKGTGFSSIKLICCAFNTWIMECYKN

SEQ ID NO: 1540 - protein, 371 aa, Argemone mexicana
MDVNNGIVETSIYMSRVGKLGSYSAISMALRAAIELNLFEIISGFGPEAQVSATDLVSKMSNIINNPNAPIFLDRILRLLGVSSILSMSTRAISPLSSSNGKIMNKVERVYGLTEESRSLVPREEDGVSLLPTLMFTTSKLVVESFFNLKGVVLQKNYVPFDMTHGVSIFEYACNEPKLNKGFNEAMGFFSVIVFEEVFRVYNGFVGMKELLDVGGGTGTSISKIVSKYPSIHGINFDLSHVISVAPQYPGIENIAGDMFEEVPKAQNILLKWVLHDWDDERCVKILKNCWKSLGYEGGKVLVMEFVLPDELGDNTQTYNALVPDLLMMALNPGGKERTLSEYTELANASGFLKTKSYPISHGLRVIEFHK

SEQ ID NO: 1541 - protein, 361 aa, Argemone mexicana
MGSTQNQDEETQACMYAMQLASASVPVMVLKTVIELDVLEIIKKSGPCSKLSATEISSQIPNLKNPDAPVMLDRMLRLLASYNILTCSLKEQDQDLKIERVYGLAPVCKFLTKNEAGCSMSALLLMNQDKVLMESWYHLKDAVLDGGIPFNKAYGMSAFEYHGTDPRFNKVFNKGMSDHTTITMNKILETYKGFEGLNSIVDVGGGIGATINMIISKYPTIKGINFDLPHVIEDAPSFPGVKHMGGDMFGSIPNGEAIFMKWILHDWSDEHSLKILKNCYEALPKNGKVILVECIIPEIPDSNVSTGHGVFHLDNIMLAHNPGGKERSQKEFETLAKQTGFTDFKVVCSAYDTYVMEFSKN

SEQ ID NO: 1542 - protein, 358 aa, Argemone mexicana
MSKEVKGADEFAMGLQLNGGTVLGMVTKTAIELDLFEIIAKASTVNGISPFGDDAKKLSSDDIVAQLPTQNPAAPAMLDRILRFLAAKSILNWTTIVQEDGKEKSLFSLTSTCKYYISDEDGVSLAPTLVMLHDKVIIDSWYRLKDAVLEGGIPFNKAHDGMHAFEYPAIDSRFNDVFNQGMYNHTTLLMKKILEVYTGFEEITEIVDVGGGTGATLAKIISKYPLIRGINFDLPHVIKNAAPLAGVEHVGGDMFESVPKGEVIFMKWILHDWSDDHCLKLLKNCCNSLPEFGKVIIVESVVPEYSDKGSSAELDNAVNGDMIMLALNPGGKERSLKEFEELAKESGFAAVKLICSAS

SEQ ID NO: 1543 - protein, 350 aa, Berberis thunbergii
MELNGKDESVDIKAQAHLWKIIYGFADSLVLRCAVELGIADIINDNNQPITLPDLAAKLPVSNVNFDHLYRILRYLAHMKLIKQEEKRGVTLYSLEPIGTMLVKNAKRNMVPIILGMTQKDFMTSWHFMKDGLSNDGTTAFEKGMGMTIWEYLEGHPEQSQLFNEGMAGETRLLTSSLINGSRDLFKGINSLVDVGGGNGTTIKAISDAFPHIKCTLYDLPHVVANSYDLPNVERIPGDMFQSVPSAQAILLKLILHDWSDEDCIKILKKCKEAVPKEGGKVIIVDVALDEESDHELTSTRLILDIDMLVNTGGKERSKEDWDKLIKAAGFKGFNIRHIAAVQSVIEVFP

SEQ ID NO: 1544 - protein, 353 aa, Berberis thunbergii
MAANSEMVEENIIANQAKLWNSIYGFSETFVLRCAVELDIATIIHNHGKSMTLSELVSQLTVKQPVNSDSLSRLMRYLVYIDIFTDTVDVDRETRYGLAPLGKFLVKGSDHCVVEEMLVVTDKEFMAPWQCIKDGITDGSKTAFEKTFGMNIWEYMGKHSEKNTTFNEFMASDSRIMSSELVNKCKDKFQGLNSLVDVGGGTGTTARSIAKAFPSIKCTVYDLPIVLADSLVCPEITQVSGDMFKFVPSADAVLLKYILHDWGDKECIEILKRCKDAVPKDVGKVIIIDTVLDVKSDHPYTKLKLSLDLDMMINTGGKERSEEEWKTLIQAAGFKNYNITQLSALPSVIEAFP

SEQ ID NO: 1545 - protein, 349 aa, Berberis thunbergii
MEEESIAHQAKLWNIIYAFSDSLVLRCAVELDIANIIHNHGKPMTLSELASVLPVKQPVNSDSLYRVMRYLAHLKVFTKTLDADGETRYGLAPPAKFLVKGNDMCMVGSLMGLTDKDFMAPWQYIKDVLSGDDGKTAFEKALGMDIWEYMGENPEKNKLFNEAMACDTRLVLSALINECKDKFQGINSLVDVGGGTGTAARNLVKAFPHLKCTAYDLPHVIADSPVYPEINQVPGDMFKVIPNADAILMKCILHDWGDKECIEILKKCKEALPKEGGKVIIVDIVLDVKSEHPYTKLRLTLDVDMMLNTGGGKERTEEEWKKLIQAAGFKSYNITQISALQSVIEAFPY

SEQ ID NO: 1546 - protein, 369 aa, Berberis thunbergii
MAPQMCSEILNGDGGEDLLGVQAHIWNHLFNFISSMSLKCAVELQIPDIIHDYPKSPVTLSELVAALGIPETKSTHLYRLMRLLVHSGFFAIRKVHDTLEEKEGYVLTPSSKLLLRNHNKSMSPFLLMILDPAIVNPFHFLSEWFQSDEMITPFEARNGVPFFRYFGENDQVLGKMFDESMGCDAQLVMSVVLKECKAKFEGLKSLVDVGGGIGTVAKVIAETFPGVKCTVLDLPQVVGSLIGSANVEFVSGDMFEFIPSAHAVFLKWIMHDWSDEECVKILKHCKEAIPSKEEGGKVIIIDMVVNDSNNKGNYESTETQLVFDLLIMSLLPGRERTEAEWEKLFLDAGFSSYNITPVLGLRSLIEVFP

SEQ ID NO: 1547 - protein, 345 aa, Berberis thunbergii
MEENIKAQALLWKYIYGFADSFVLKCAIQLGIADILHEHGQPMTLSELATSLPHPSINEDRLYRFMRYLVHMKLLGKVELDGLIKYSLTPESKLVIKNQEKSLASFALLLSYEMDAWHHLSASVEGGDLTPFERCKGMGYREYFAKNSAANQLLSDAMTSHTSMVTDAVVKGFEKAHVLDGMTSLIDVGGSTGVAARAIAKAFPEVKCAVFDLPHVIATAPECPEVTRIEGDVFVSLPKTDLVFMKSVLHDWGDEDCVKILNKCKEAIADSKQGKIVLVEIVMDAVSTDDEFKSAKLGMEMDMLVTVAGKERSEQEWQRLFKAAGYSRYHITPIVAIESIIQVFP

SEQ ID NO: 1548 - protein, 332 aa, Berberis thunbergii
MYGFVNSMTLKCALQLGLPDLIHKHGEPMTLTQLVNSIPVPSPDPDYLFRIMRFLVQNNLFTCSEDEKSGELKYGLTPESELLVMNHDKSLAKFVLQAMHLNQMSAWQHLIDGLGCDTYPWMVCHKTTWHESAVKDVECLQLYIDSMKSYTTHVVEPLVSGCIGECVFDNVNTIVDIGGNTGITAKAVVDAFPDVKVTVMDLQEVIDQPHIDHPRIEYLAGDAFSFIPKADVIFMKSFLHGYSEEQCIEVLKKCKEAIPLKTGKVVLVEIAVDAEGFPEFAMPKLCMDMEMLIVGGKERNIKDWANILTKAGFTQHKIIPIAALESIIEARP

SEQ ID NO: 1549 - protein, 357 aa, Berberis thunbergii
METIVGNRKQMEEDDEEIKARAQIWKHMYGFAETMVLRCALQLNIPDIIHKHGPMTLPELASKLPLGSTNIDRLHHVMRYLVHMNLFTSRPSETSKVITYGQTAASKLLLKDHENSLCPYAMLQTHPEAFSMWAHIVESLDGSKAYWDSTYGESLYQKIENEPAHMKMVNDAMTSHTRSIARAVVSGLAREQVLNGVGSLMDVGGNSGEAAKAIKDGFPHVKCSVMDLAHIIENVPRKPDLDFVSGDMFASVPNADVVFAKSVLHNYEDVDCLKILIKCKEALPSLGGKLVLVEIVLDAENLPELAFARLGMDMEMICMGGKERTKQEWGDILHKAGFSHHKIIPIMAIESIIVAYP

SEQ ID NO: 1550 - protein, 345 aa, Berberis thunbergii
MDTLNGYTDHFEDDEDISAQALVWNHMYGFANTIMLRCTLRLNLPDIIHKEGPLTLSQLASKLPFNSINLDRFNHIMRYLVHMKLFKIVNKDKYALTRASELLVKSHEKSLAPFAMLQTHPQEFTVWGHFIENLDKAKNYTEVYHEMDNDPEINKLVNEAMTSHTKCMVPALVSGLTKENVLADVKSLIDVGGSEGIASKAIIDVVSHVKCIIMDLAHVIDTVPKDPRLDFLAGDMFDFVPKADAVMLKSILHNYDDDNCLKILTKCKEAIPTKGGKVVIVEIVIDTQNLPEFSSARLGLDMEMICMGGQERTKQEWATLLHKAGFDHHTIIPIRAIESIIVACP

SEQ ID NO: 1551 - protein, 363 aa, Berberis thunbergii
MAFTHNGLATQESPSYLSGLGLSRLICLPMALRAAIELNVFEIISQAGPKAQLSSSQILTKIPTKNPNGAIALERILRLLGASSILSVSTNSSNQRVYGLTSESRTLVPRADQVSVVPMLLFTADKAVVESFYMLKDVVLDEPGCIPFDKTHGMNFFEYAGKEPRVNKVFNQAMAVGSTIAFDEVFKVYNKGFDGMKELVDVGGGIGTSLSSIVAKYPHIRGINFELDHVIADAPAYPGVEHIAGNMFEGVPSAQNIMLKWVLHDWGDEQGLIILKNCWKALPENGKVIVIEFVLPEVLGNNAESFNALTPDLLMMALNPGGKERTIAEFSGLAKEAGFEEVKPFPISQGLHVIEFHKTKACA

SEQ ID NO: 1552 - protein, 363 aa, Berberis thunbergii
MGSTTHTPIKITAQEEDEACSHAMQLASASVLPMVLKAAIELDVLEIIAKAGPGAYISPAEIVSQLSTTNPEAPVMLDRMLRLLASYKVVTCTLKTSEGGEVERLYGLAPVCKFLVKNEDGVSIAPLVLMNQDKVLMESWYHLKDTVLDGGIPFNKAYGMTAFEYHGTDPRFNKVFNRGMADHSTITMKKILEVYTGFDGLKSLVDVGGGTGAIINTIVSKYPSIKGINFDLPHVIEDAPSYPGVEHVGGDMFVSVPKADAIFMKWILHDWSDEHSLKFLQNCYNALPSDGKVIIAESILPVLPETDLAANGVFQLDNIMLAHNPGGKERTEKDFEGLAKKAGFSGFKVVCRAYGTYIMEFSK

SEQ ID NO: 1553 - protein, 361 aa, Berberis thunbergii
MALIQNQVRAAGDEEADCLFAMQLASSSVLPMVLRAAVELNVLEIIAKAGVGAQLSAKEVASHITSQNSDAPVMLDRILHLLASHSVLTCSGVTREDGTVERLYGLAPVCKYLVRNADGVSFAPLLMSTQDKVFMDSWYHLKDTVVEGGIPFNRVHGVHAFEYPGIDPRFNEIFNQAMFGHTTIIMKKMLETYKGFENLKEVVDVGGGLGTTLKIITSKYPTIKGINFDLPHVIKHAPSSPGVEHVGGDMFASVPKGEVIFMKWILHDWSDEQCIVLLKNCYKALPEHGKLIIVEGILPEVPETSVANQGLCQIDLVMLAQNPGGKERTEKEFRTLANLSGFAGVYKVCCTCNYWVMEFFK

SEQ ID NO: 1554 - protein, 375 aa, Berberis thunbergii
MSPNQNHQNTTVAYPPNHQNPHTATNEDNESFLLAMQVVNTLTFPMVMQAIIELDVLEIIAREGQGAQLSPSQIASHLPTKNPEAPMMLDRMMRLLACHNMLTCSVVTLKSGKAERMYGLTPLCKFFIKDGNGISLAPFIKWMHHKDLMQSWYHLKDAVLEGGVPFDMAYGMDVFQYFGEKAELHELFNRMQFIHTTTVTNKILETYKGFHGLKEVVDVGGGLGVMIDGITTKYPTIQGINFDLPQVIEHAPRYQGVEHIGGDMFISIPKGETIFMKFVLHDWNDEQCLILLKNCYKALPNHGKVIVVEIIAPVIPKDDASSRVSCQEDIIMMAQAPGGKERTEKEFEALALGAGFVGVKLVCSACYYWVMEFHK

SEQ ID NO: 1555 - protein, 349 aa, Corydalis chelanthifolia
MGVNDIAEVQDVDLKAQAHLWNIIYGFADSLVLRCAVELGIADIINSNNGPVTISEIASKLPVDNVNTDNLYRVLRYLVYMGLLKESQNKCYSLEPVATLLLKDAQRSMVPIILGMTQKDFMVPWFFMKEGLGSGSSTAFEKGMGMTLWEYLEGHPDQSQLFNEGMAGETRFLTSSLINGCRDTFEGLTSLVDVGGGNGTTIKGIHDAFPHIKCSVYDLPHVIANAHPHPNIERIPGDMFKSVPSAQAILLKLILHDWTDEESVNILKRCREAVPKEGGKVIIVDVALEEGSQHELTKTRLILDIDMLVNTGGRERSVDDWDRMLKLAGFSSHKIRHIAAIQSVIEAFP

SEQ ID NO: 1556 - protein, 347 aa, Corydalis chelanthifolia
MEVIKKSDQADQAKLWKFIYGFADSLVLKCAVELEIADTIHKHGEPMTLSELATKLPKQPIDTDRLYRIMRYLVQMKLFTKETSQSGEVKYGLLPPAKFVVRGWQNSMVGSLLAINDKDFIAPWHYLKDGLGGECDAFEKALGKKIWDYMSENPEKNQLFNEAMACDTRHILISALIKDCKDVFKGIKTLVDVGGGTGTAVKAISDAFPDIKCAVYDLPHVIADSPVAPNIDRIEGDMFKSIPNADAIFMKCILHDWNDDECIQILKQCKKALQDGGKVIIVDVVLNVDSKHPYTKMRLTLDLDMMLNTGGKERTEEEWKELFEAAGFSGYKIIQISALQSVIEAYP

SEQ ID NO: 1557 - protein, 348 aa, Corydalis chelanthifolia
MNMSELSLENDAKIWKYIYGFGDTLVLKCCVDLGIADTIHKHGQPMTLSELASQLSNDQQQTIDTDRLYRLMRYLVQLKLFTTEGSQLGEIKYGLLPPAKFLIRGWQKSMGGMVSLIDEDFIAPWYHLKDGLDGHTDPFQMAFGKKLFDYLSENLERSQLFNEYMAIDSKLLTLELVNCKNVFEGIKTLVDVGGGTGTTVRAIADAFPHIKCMVYDLPHVNADSPVDPDIERIDGDIFKSVPKADAILMKWILHDWNDNECIQILKHCKESIPQDGGKVIIIDVVVNVNSNHPYTKVRLYSDLDMMINTGGKERTEEEWKNLLEAAGFTGYIHTEISAVQSIIEAYPY

SEQ ID NO: 1558 - protein, 367 aa, Corydalis chelanthifolia
MGSTENEIKTSATTTKEEEEEEACLYAMQLASASVLPMILKSAIELDLLEIMAKSGVGAYISPSELASQLPTTNPAASTMLDRMLRLLAGYKVLTCKLNTLDDGRVERLYGLAPVCKYLIKNEDGVSMAPLVLMNQDKVLMESWYYLKDTVLEGGIPFNKAYGMPAFEYHGTDPRFNKVFNKGMSDHTTISMKKILETYKGFEGLNSIVDVGGGTGATVSMIVSKYPSIKGINFDLPHVIEVAPAYPGVEHVGGDMFASVPKGDAIFMKWILHDWSDEHNLKTLKNCYEALPADGKVIIVESILPVFPETKSAAVGVFHVDVIMLAHNPGGKERTEKEFEALAKEAGFSGFKVVCCAFNSWIMEFCK

SEQ ID NO: 1559 - protein, 356 aa, Corydalis chelanthifolia
MEMTINGGDKEQEMKCQGQVWNHICGIVDSLVLKTTLELSIFDTVHTHTNSTITFSQLSKSPSLASIKPKNLYRLLRYLVHLNLLTIKVVEGEETFSLTNLSMLLLENQEKSLRDWSLGIDDPTSINIWHELSKFVTDPADAPTPFVQIHGKTLWELAGEIPEVNTLINNAMACDTRLVMPAVVQGCQELLNGISSLVDIGGGTGAAMTYVAKAYPHVKCKSFDLPHVVAEAPAFPGVELIGGDMFEFIPPADAISLKFMLHNWQDEACIKLLKRCKEVIPADNGKVIIIDIVLDQDEDDDELTKARVSLDIDMLLSSGGKERTKDEWRVLVEKAGYSRVEIIPIFAIQSVIVAYP

SEQ ID NO: 1560 - protein, 343 aa, Corydalis chelanthifolia
MQLASASVLPMVLKSAIELDLLETIAKAGPGAYVSPTELAAQLPKSDNPEAPVMLDRICRLLASYKVLTCTLKNKDDDGHVVERLYGLAPVCKFLVKNEDGVSVAPLLLMNQDKILMESWYHLKDSVLDGGIPFNKAYGMSAFEYHGKDQRFNKVFNSGMFDHSKMTMKKILDIYDGFNGLTTLVDVGGGTGASLSMIVSKHPSIKGINFDLPHVIEDATTYPGIQHVGGDMFESVPKGDAIFMKWICHDWSDEHCVKFLKNCYKALPENGKVIVAECILPEAPDSSLATQNVIHIDVIMLAHNPGGKERTEKDFEALAKGAGFKGFRKAACALNTWVMEFCK

SEQ ID NO: 1561 - protein, 341 aa, Corydalis chelanthifolia
MQLATASVLPMVLKTAIELDLLEIIAKAGPGGSVSSSELAAQLPLVNNPEAPVMLDRICSLLASHSVLTCKLKETSDGCATQFYGLAPVCKFLIKNESGVSLAPLLLMNQDKVLMESWYYLKDAVFDGGVPFNKAYGISAFEYHGKDPRFNKVFNSGMFDHSTMSMKKIVDLYDGFEGVQTLVDVGGGIGASLNMIISKHTSLKGINFDLPHVIEHTATYPGIEHVGGDMFNSVPKGDAIFMKWILHDWGDAHCLELLKNCYKSLPDGGKVIVAECILPEVLDSTKLTQSVRQIDMIMLAHGVGGKERTEKEFEALAKGAGFKGFRKAICALNVWVMEFFK

SEQ ID NO: 1562 - protein, 352 aa, Chelidonium majus
MGVNDMAVSQEVDIKAQAHLWNIIYGFADSLVLRCAVEIGIADIIKNNNGSISVSELSSKLPISNVNSDNLYRVLRYLVHMGILKEDSDINGVKLYSLQPVATLLLRDAERSMVPIILGMTQKDFMVPWHFMKEGLGDGSTAFEKGMGMTIWQYLEGHPEQSQLFNEGMAGETRLLTKSLIEGCRDTFEGLTSLVDVGGGNGTTIKGIYDAFPQIKCSVYDLPHVIASSPEHPNIERIPGDMFKSVPSAQAILLKLILHDWTDDECVNILTKCREAVPKETGRVIIVDVALEEESQHELTKTRLILDIDMLVNTGGRERTEDDWEKLLKRAGFRGHKIRHIAAIQSVIEAFP

SEQ ID NO: 1563 - protein, 356 aa, Chelidonium majus
MGSSSIDVKPAETQEVSIKDQAQLWNMIYGFADSLVVRCAVELGIPDIIKNNNGPITLAQLSSKLPIPNVNSDHLYRIVRYLINLNILQQEICRNVKVYSLKPVGTLLLRDAERSMVPILLGNTQKDFLVPWHFVKEGLVNGSTTAFEKGMGMDIWKYLEGNPDQSQLFNEGMAGETSLLTKTLIEDCRDTFQNLDSLVDIGGGNGTTIKAIYEAFPHIKCTLYDLPHVVANSHDLPKIEKVPGDMFKSVPSAQAILLKLILHDWTDEECVNILKKCKEAIPKETGKVIIVDVALEEESNHELTKTRLILDIDMLVNTGGRERTADDWENLLKRAGFRSHRIRPIRAIQSVIEAFP

SEQ ID NO: 1564 - protein, 354 aa, Chelidonium majus
MGSSIDAETQEVGIKDQAQIWDIIYGYADSLVLRCTVEIGIADIIKNNNGSITLSELVSKLPLSNVNSDNLYRILRYLVHLNILGQQTCAAGGDRVYSLKPVGTLLLKDSETSMVPVILGLSQKDFLFVWNFVKEGLGTGSTTAFEKATGMDMWKYLEVTPDQSKLFDEGQAGETRLLTKTLLEDCRDTFQGMDSLVDVGGGNGTTIKAIHEAFPHIKCTLYDLPHVIANSDDHPNIRKVPGDMFMSVPSAQVLLLKCVLHDWTDEHCVNILKKCKEAIPKETGKVIIVDVALEEESEHELTKARLILDIDMLVNTGGRERTEDDWEDLLKRAGFRSHKIRPIRAIQSVIEAFP

SEQ ID NO: 1565 - protein, 348 aa, Chelidonium majus
MEATKIDQANQAKIWKLIYGFAESLVLKCAIQLEIAETIHNHGKPMTLSELASKLPVQPVNSDRLYRVMRYLVHMKLFNKEETSINGEFKYSLAPPAKFLIRGWEKSMVASILAINDKDFLAPWHHLKDGLSGNCDAFEKALGKSIWVYMSENPEKNQLFNEAMACDTRLVTSALVNDCQSIFQGIKTLVDVGGGTGTAVKAISKAFPHIKCTIYDLPHVIADSPEIPNVVKIEGDMFKSVPNADAILMKCILHDWNDDECIQILKKCKEAVPQQGGKVIIVDVVLNMDLSHPYSKIRLTLDLDMMLNTGGKERTVEEWKKLIDAAGFASYKITQISAVQSVIEAYPY

SEQ ID NO: 1566 - protein, 364 aa, Chelidonium majus
MDSSSTQEMNDTELMQARAHIFNHVCSFISSMSLKCAIQLDIPDIIHNHGKPITLSSLVDVLSLPPSKSHALYRLMRLLVHSGFFARQKIDQNQEEGYVLTPSSRLLVKEVNNKYSLSSYVTNLLDPSLLKPCHFLSDWFKGSGSTAFEAAYGVPFWSFMQEHFEYGKIFNEAMAVDSRLVLSVTVNDCSAVFENLSSLVDVGGGTGTAAQVISEAFPHLRCVVLDLPHVVADQLPKSINKNLDFIAGDMFESIPSANAVLLKNVLHDWGDSDCIKILKRCREAIPSREEGGKVIIMDIAVEDRKEEHATTETQLYYDMFMLTMYTTGKERTEKEWEKLFLESGFSDYKITPLKGFSSLIEVFP

SEQ ID NO: 1567 - protein, 357 aa, Chelidonium majus
MEVVSQIDQENQAIIWKQIYGFSESLLLKCAVQCEIAETIHNHGTPMSILELAAKLPIDQPVNIERLYRVMRYLVHQKLFNKEVITTLNGGTVQVTEKYWLAPPAKYLIRGSQQSMVPSVLGIIDEDMFAPWHILKDSLTGECNIFEKALGKSISVYMSENPEMNQISNGAMAFDSGLVTSHLVNECKNIFGDEIKTLVDVGGGTGTAITAISKAFPNIKCTLFDLPHVIADSPEIPTITKVSGDMFKSIPRADAIFMKNILHDWNDDECIQILKRCKDVVSAGGKLIIVEMVLDEDSFHPYSKLRLTSDIDMMVNNGGKERTEKDWEKLFDAAGFASCKFTQMSVGFAAQSIIEVY

SEQ ID NO: 1568 - protein, 353 aa, Chelidonium majus
MEIQLGDQEQEMKYQGKVWNHICGSVDSAVLKCTIELGLLDTIHSSSKPITLSDLSTSPSLSSLKTQNLYRLLRYLTHMNLITINSTEGIETFSLTDLSKLLLKTQERSLKDWVLGIDDEHSITSWHELSSYCCSPDDAPTPFVKLHGKTLWELAEEVPEVNELINNGMACDTRMVMPAFVQGCEKILNGITKLVDIGGGTGAAISYVVKAFPHIKGTVFDLPHVVATAPEIPGVEMVGGDMFESIPPADALLLKFMLHNWKDDECIKLLKRCKGAIPTDQGKVIIIEMVLDQDEDDDDLTQARLSLDLDMMLSSGGKERTKDEWRVLLETAGFSRIEFIPIFAIQSVIVAYP

SEQ ID NO: 1569 - protein, 446 aa, Chelidonium majus
MKDMFRIREKRGERERGERGNQVINNYVQDEGVVGSFRNLVVEFITTYIFPSSPTMVHHHYLAIKLFFFFYQYQINPRIEEMGSTQNQFNATTDEDEEAQACMYAMQLASATVPVMVLKTAVELDLLEIIKKAGPGAQISCTEISSQIPNNKNPDAPVMLDRMLRLLASYKILTCSLRDLEDGKVERLYGLAPVCKFLTKNEVGCSMAPLLLMNQDKVLMESWYHMKDAVIDGGIPFNKAYGMSAFEYHGTDLRFSKVFNKGMSDHTTIVMNKILGTYKGFEGLKSIVDVGGGVGATVNMIVSKYPTIKGINFDLPYVVEEAPSYSGVEHVGGDMFVSVPKGDAIFMKWILHDWSDEHSVKILKNCYEALPENGKVIIVECIIPVIPDGASGHGVFHLDNIMLAHNPGGKERSEKEFEALAKGTGFTGFKVVCSAFDTHVMEFSKN

SEQ ID NO: 1570 - protein, 367 aa, Chelidonium majus
MGSIENQFKTNPIEVEEEACMYAMQLASASVPVMVLKAVVELDVLEIIAKAGPGAQISVADIVSQIPNVKNPNAPVMLDRMLRLLASYKILTCSVKDLDGQGLVQQRLYGLALVCKFLVKNEDGCSMAPLLLMNQDKVFLGSWDHLKDAVVDGGIPFNKAYGMNAFEYQGADPRFNKIFNRAMSDHATITMKKILETYKGFEGLNTLVDVGGGIGVTIDMIVSKYPSIKGTNFDLPHVIKDAPSYPGVEHVGGDMFVSVPKGDAIFMKWILHDWSDEHSVKILKNCYEALPEHGKVILFECIIPAYPETSLASLGVFHVDNIMLAHNPGGKERSEKEFEALAKGTGFAGFRVICSAYNTWIMELSKN

SEQ ID NO: 1571 - protein, 369 aa, Cissampelos mucronata
MTVLEGLTISVLCTPITSFGKNTMEEAMDVHEQAHLWKLIYGFVDTLVVRSAVELGIFDIINNNLKPMTVLDLASKLPISNPCSDRLYRILRYLVHVRLLKVTDIDGLKRYSIQPVARFLLRDYDKSMAPIILGMTKKEFMSSWHHIKDGLSDDGSTAFDKAMGMSFFEYLEENPSQSKLFNEAMAGETRLLTASLINDCKDIFQGIESLVDIGGGNGTTIKAISDAFPHISCALFDLPHVVADSNDDHPNIKRVAGDMFESIPTSQAILLKLILHDWSDEDCVRILKRCREAVPKEGGKVIIVDVALEEESKHELNNPRLVLDIDMLVNTGGKERSREDWEKLTKLAGFGGYKIRHIAAIQSVIEITP

SEQ ID NO: 1572 - protein, 343 aa, Cissampelos mucronata
MEEEMKAQAQVWRYVYGFADSLTLKCAIQLDIPDILHRHGRPLSLSALASRLPLPTVNPDRLHRLMRYLVHMGLFDLVPSPDEPAYASNPSSALLVKGQPKSLASFALLQYYEMDAWHHLSAAVEGSVTPWERCHGVDYREYFAKDPVANQLLSDAMTSHTSMVTEALVEGCRKAGALDGVRSFVDVGGSTGVAARAVAKAFPGIKCSVFDLPHVIATAPECPEVERIEGDMFASVPETDVVFMKSVLHDWGDEDCVKILKKCKEAIAGKEGGKVVILDIVLDVESSYEFKGARLGMEMDMLVTVGGKERSEAEWQKLIKDAGFSRYKITPIVAIESIIEVFP

SEQ ID NO: 1573 - protein, 354 aa, Cissampelos mucronata
MATTEQEESLRGQAEVWDCMFAFADSMALRCALELRIPDIIHSHNRPITLSEILTSIPSPSPDHTCLSRIMRLLVRKRIFSVTTTSSGAAQEPAYGLTRSSKWLVTRGAELTLAPMALMETHPEMMAPWHWLSRCVAEGGAAFEKAHGMEIWEYASVHPEMNKIFNAGMECASKVLVRTLLVGYEKGFDGVGTVVDVGGGTGMLIGEIVAAHPGLKGINFDLPHVVASAPDQANVVNVAGDMFVEVPRADLVVMKWIMHDWNDEDCTKILKNCRKAIPEKGGKVVIIDLVLRPEGNGLFDSTGVVFDLLMIAHSSGGKERTENEWKKILKAGGFPRYNIIQVPTLVSIIEAFPL

SEQ ID NO: 1574 - protein, 368 aa, Cissampelos mucronata
MSSIAAGAEQEQEMKLQAQVWNHVAGGFANSIVLKCAADLSLFDAIQDVHNKQGKPVTPSTLIRTSPNLSPMNPHKLFRLLRFLAHMKLLNIHAFDHDNVDDEDEVCFSLTELAKFMLRSNEKNIVDWVLGVPDEPAINAWHQLGNCMSFPSEGPTAFEEEHGKTLWEFARDNADMNKVFNDAMACDTRLVMPAFVEGCRDVLKGVSSLVDVGGGTGTAMSYVVKAFPHVKCTVYDLPHVITTSPEYPGVELVGGDMFQSVPHADAVLLKYMLHNWQNEGCVKILKKCKEAVPKEKGKVIIIDVVIDQDEDNYDVTHIRLSLDMDMMGMSGGRERTKEEWSVLMKLAGFSRYEIIPIFAMQSVIVAYP

SEQ ID NO: 1575 - protein, 371 aa, Cissampelos mucronata
MGSTHTDVSSTVVMTPAEEEEACMYAMQLASASVLPMVLKAAIELDVLETIAHAGPGAHLAPSEIVARLPNCTNPDAAVLLDRMLRLLASYRVVSCSVRTTEVGGVERAERAYGLGGVCKFLVKNEDGVSMAPLVLMNQDKVLMESWYHLKDAVLDGGIPFNKAYGMTAFDYHGTDPRFNKVFNRGMSDHSTITMKKLLENYKGFDALKSVVDVGGGTGATLNMIISKHPTIKGINFDLPHVIEDAPTYPGVEHVGGDMFVSVPKGDAIFMKWILHDWSDEHCKKFLKNCYAALPEDGKMIIVESILPVFPETNLAAHGSFQLDNIMLAHNPGGKERTSKDFEGLAKEAGFAGFNVVCGAYNSWIMEFLKK

SEQ ID NO: 1576 - protein, 354 aa, Cissampelos mucronata
MSEGDHSTNYLVGLGLGRLICIPMALRAAMDLHVFEIIAAAGPGALLSPSEIVSRIPTTNPNAAAALDRILIMLAAGSLLSVATRHSTAERAYGLTPESLTLVPSKEGVSVVPMMLLAFDDALMKCFHGLKHAVLEEGCVPFDKSHGMNFFEYAEKEPRVNRVFNEAMAASSAIAFQEVFKAYDGFKEVKELVDIGGGIGTSLRSVVCKYPHISGINFDLSHVIAGAPPYPGVKHVEGDVFEGIPNGQTLMLKWVLHDWSDEHCKKILKNCWNALPKEGGKVIVIEYVLPEELGNNSGDSFNALVADLFMMNLNSGGKERTLAQFRDLAKIVGFFEIMVFPICRDLHVLEFLKK

SEQ ID NO: 1577 - protein, 351 aa, Cissampelos mucronata
MEDKSASKVMELLGLGPLQMSLKLAIELKLFEIINSSGPQSMLSASQIASHLPTSNSSASSSLDRILSLLASHSILTTTLGEKGERLYGLTPICNYFVPDQNRVSLGPLFMFFHDKVLMESWSYLKNRVLEGSVPFNMAHGMGVFDYMAKDERFRRVFNEGLYNHSVSVMGDLLEKYKGFDESVAEVVVDVGGGIGASMKMLVSKYPHIKGVNFDLPHVVADAPPSPGVEHVSGDMFKGVPNGDIMFMKFILHTFDDEHCVAILKNCWNALPEHGKVLIVEHVLPPSNISEYPDESRLAFTADAMMLVYRDGGRERTLVEYEELAKRGGFHGMKAFPCSLGIIAIELQKGS

SEQ ID NO: 1578 - protein, 342 aa, Cocculus trilobus
DQAAQAQLWKFIYGFAESLVIKSAIQLDIPDIIDNHGKPITISELASRIPSQGPVDHDRLYRIMRYLVHMKLFTKESIDGEDQYGLAPPAKYLVKGWEKSIVPSILCITDKEFMSPWYHLKEGLSNGDNQTAFEKALGVNIWDYMSKNPKKNNIFNEAMACDTRLLMSALVSECKDMFQGIKSLVDIGGGTGTAVRYIAKAFPHINCTVYDLPHVAADSPTYPEVNRIEGDMFKYIPSADAILMKCILHDWADEECIQILKKCKEALPSTGGKVILVDIVLNAYSEHPYSKMRMVMDLDMMLNCGGKERTEEEWKKLIYAAGFSRYNIRQVNAIQSVIEVYP

SEQ ID NO: 1579 - protein, 343 aa, Cocculus trilobus
MEEEMKAQAQVWRYVYGFAESLTLKCAIQLNIPDILHQHGRPMTLSELASHLPLPTVNQDRLFRVMRYLVHMGLFDLVDSPDSKKYSLNSASKLLIKGQDKSLASFALLQYYEMDAWHHLSAAVEGGATPWEKCHGVDYREYFSKDSVANQLLSDAMTSHTSMVTEALVEGCKKANVLDGVRSFVDVGGSTGVAARAVAKAFPNVKCSVFDLPHVIATAPECPEVTRIEGDMFVSIPETDVVFMKSVLHDWGDEDCVKILKKCKEAIAGKDGGKVVILDIVLDAESSYEFKGARLGMEMDMLVTVGGKERGEEEWQKLFKAAGYSRYKITPIVAIESVIEVFP

SEQ ID NO: 1580 - protein, 353 aa, Eschscholzia californica
MGLEFNEEVDIKAQAHLWNIIYGFADSLVLRSAVELGIADIIKNNNGSITVSELASKLPISNVNSDNLYRVLRYLVHMGILKETKSTINGGEIKKLYSLEPVGSLLVKDAERNMVPIVLGMTQQDFMIPWHYIKEGLGEGSTAFEKGMGMTLWEYLEGHPEQGHLFNVGMEGETRLLTKTLIESCKDTFEGLSSLVDVGGGNGTTIKAISEAFPHIKCSLYDLPHVVADSHDLPNIEKIPGDIFKFIPNAQAILLKLILHDWSDEDSVKILKKCREAVPQDTGRVIIVDVALEEESEHPLTKTRLVLDVDMLVNTGGRERSEDDWAKLLKLAGFRTHKIRHIAAVQSVIEAFP

SEQ ID NO: 1581 - protein, 348 aa, Eschscholzia californica
MEGADKIDQATQAKIWKHIYGFAESLVIKSAVELEIADTIHNHGKPMTLSELASKLPVQPVDLDRLYRVMRYLVHMKLFKKQEDEEESIKYSLLPPAKFLIKGWEKSMVSAILLINDKDFMSPWHHLKEGLVNNSNAFDKALGKSIWDYMSANPDKNKVFNEGMACDSRLVSSALVNECGNIFQGIQTLVDVGGGTGTAVKAVSKAFPHIKCSIYDLPHVISDSPDIPNIVKIEGDMFKSIPSADAILMKCILHDWNDEECIEILKKCKEAVPKEGGKVIIVDIVLDMESKHPYSKVRLTLDLDMMLNTEGKERTEEEWKKLIDGAGFASYKITQISALQSVIEAFPY

SEQ ID NO: 1582 - protein, 348 aa, Eschscholzia californica
MELANKSDQATQAKVWKHIYGFAESLVLKASIELQIADTIQNHGKPMTLTELSSQLPNQPVNSDRLYRVMRYLVHMKLFQKQESSINGEIEYSLLPPAKFLLKGSEKSMVSSILAKTHKDFLAPWNYLREGLMGNCDAFEKALGKSIWEYMSENQEMNQLFNESMASDSNLVTSALVNQCENIFQGIQNLVDVGGGTGTAVKAISNAFPHIKCSIYDLPHVISNCPEIPNIVKIEGDMFKSIPSADAIFMKCTLHDWDDNKCIQILKNCKEALPKGGKVIIVDVVLERESKHPYSKIRHTFDLSMMLNTGGKERSVEEWKKLFDDAGFPSFKITPISAVESVIEAFPY

SEQ ID NO: 1583 - protein, 370 aa, Eschscholzia californica
MSMKIKTDKCFMEFDKNNNVEDQAMETRIWDITYGFAGSLVLKCAIELEIADIIHKHGEPISLSELASQLPVNKPTDLSRLYRVMRYLIHMKLFTKEINDLGEVKYGLAPSAGKFLVRSSDDKSMATLILGAHQEAFMAPWHHLKESLSHDSSQSGTIFEKALGKSIWEYMGDNQEMNKLFNECMASDSRRMVAALISDCKNVFEGLTTLVDVGGGPGTAAKAISKAFPHIKCIVYDLPHVVAESSSTDTDVIWIEGDMFKYMPSADAILMKWILHCWEDEECIQILTQCKKAVPKVGGKVIILDIVVDEKSNHPHTKTRLTFDLDMMLNSGGKERTEEEWKNLLVHSAGFTSYKITQISALQSVIEAYP

SEQ ID NO: 1584 - protein, 312 aa, Eschscholzia californica
MELANKSDQATQAKVWKHIYGFAESLVLKASIELQIADTIQNHGKPMTLTELSSQLPNQPVNSDRLYRVMRYLVHMKLFQKQESSINGEIEYSLLPPAKFLLKGSEKSMVSSILAKTHKDFLAPWNYLREGLMGNCDAFEKALGKSIWEYMSENQEMNQLFNESMASDSNLVTSALVNQCENIFQGIQNLVDVGGGTGTAVKAISNAFPHIKCSIYDLPHVISNCPEIPNIVKIEGDMFKSIPSADAIFMKVIPNFFGSFYLCFVYLNLIPYVSLDCPNQIYKNKDKKILSLHMGQPHRRRHFSRCFYTRNA

SEQ ID NO: 1585 - protein, 356 aa, Eschscholzia californica
MDKQEDVEEEILQGQAEICKHMYGFVDSMALKCVVELGIPDIIHSHGRPITISEIINNIPNVSPSSAGIDYLPRIMLLLARKRVFATHKPDADVTETRYGLTPSSKFLLKDSDFNLAPLVLIENHSYLMDPWHYLGKCIQEGGSAFDKSHGSEIWKFGSENSQFNKLFCAGMACMAKTTLHAILVKYQDGFNGLETIVDVGGGTGMMLSGIVKKNPHLKGINFDLPHVVKEAPSYFGVTHVGGDMFVEIPRADAVFLKLILHDWNDQDCVRILKNCKTAIPKNGKLIIIDCVLNPNGEGLYDDLGVAFDLAMRVFTSGGKERSEAEWKILLEDGGFPRYKIIRIPTIPSLIEAYPE

SEQ ID NO: 1586 - protein, 361 aa, Eschscholzia californica
MEEILKVEEDRLELQGQADIWKYMFAFVDSMALKCIVELGIPDIIHSYGRPITISEIIDNIPNLSPTYNVNYLSRIMSLLVRKRIFVVHKPDLKNGTDVTESPYGLTSSSKWLLKDSEFSLVPLVLAQNHPWLLDPWQYLGKCVQEGGLPFAKAHGSEIWEFGSENPEFNKLFNTGMTCTAKIVVNAILVKYEEGFNDLRSIVDVGGGTGMMIGEIVKKYPHIRGINFDLPHVVAAAPEYPGVSHVQGNMFDEIPRADAVIMKWILHDWNDEDSVRILQNCKKAIPKNGKVIIIDCVLKPDGKDLFDETGVVLDLVMIAHTSGGRERTEVEWEKLLKDAGFPRYKISHIPTIQSIIEAYPQ

SEQ ID NO: 1587 - protein, 362 aa, Eschscholzia californica
MEKGKLEVGEEMELQGQAEICKLMLAFIDSMALKCAVELGIPDIIHSHGQPITLSEIINGIPNLSPSFDINYLFRIMRLLVRNRVFSAYEPDLKDGSSGTKTLYGLTPSSKWLVKDSKISLAPLVLAENHPWLLDPWHYLGKCVQEGGFAFAKAHGSEIWKFGSENPEFNKLFSVGMACSSTLVVDAILDNYHEGFGDLESIVDVGGAIGTLINEIVKKYPHIRGTNFDLPHVVAEALENPGVAHVGGDMFVEIPSADAVILKWVLHDWNDEDCVKILKNCNKAISNKGKLIIIECVLKPDGEGLFDGLGLAFDLLMIAHSSGGRERTEAEWKKLLKAGGFSRYKITPIKGIPSIIEAYPDI

SEQ ID NO: 1588 - protein, 353 aa, Eschscholzia californica
MDEEIILGQADICKYMYGFVDSMTLRCVVELGIPDIIHSHGRPITLTEILNGIPNLSSSFDINYLQGIMTILVRRRVFAVHKFDPKDGTNLTETRYGLTPSSKCLLKDSKFNLAPFVLLETHPWITDPWNYLGKCVQEGGSGFVKAHGSDVFKFGSDHPEFFKLFYDGMECSTKVLVHVVLDKYQQVFKDVKSIVDVGGGTGMMISEIVKNHPNIKGINFDLPHVVAEAPDYPGVEHVGGDMFVEIPQADAITMKGILHDWNDDACVRILENCKKAIPKNGKVIIIDCVLNPDGDDLFDDIKVVSDLGMRVHCSDGKERTEAEWEKLLKKGGFPRYKITHVVTVQSMIEAYPE

SEQ ID NO: 1589 - protein, 354 aa, Eschscholzia californica
METQVRNQEEEIQWQGQIWNHICGSVDSAVLKCTIEIGLLDTIQNSKKPITLTQLSNSPSLSSFKTQNLYRLLRYLSQMDLVTITTNEEEEETFSLTDVSKLLLCDQERSLKDWVLGIDDEHSINSWHELGSYISSPDDSPTPFVKLHGKTMWELAEEVPEVNELINNGMACDTRMVMPAFVHGCEKILKGVKKLVDIGGGTGAAMNYVVKAFPEIKCTVFDLPHVVATAKEIPGVEMVGGDMFESIPNADALLLKFMLHNWVDEECIKLLKRCKETIPRDQGKVIIIEMVVDQDEDDYDLTRARLSLDLDMLLSSGGKERTKDEWKNLLESAGFSKVEFISIFAIQSVIVAYP

SEQ ID NO: 1590 - protein, 357 aa, Eschscholzia californica
MEIKMEDQEQEMKWQGQIWNHICGSVDSIVLKCAIELGIFDIIHSSAGSSMNLTLSELSKSLSLLFPNKPENLYRLLRYLSHMNLITITTVEENEIFSLTYLSKLLLRNQEKSLRDWAIGITDELTVSVWHELGSFCSNTTDSTPFEKVHGKTAWELPEENSRLNMVINNMMASDTRLIMPAFIQGCGKVFDGITSLVDIGGGVGIAMSYVVKSFPHIKCTVFDLPHVVNSITEYPVGVDMVGGDMFVSIPCADAILLKYILHNWEDEGCTKILEKCREAIPAEGGKVIIIEIVIDQDDDDDNLAQAKLSLDLDMMVCSGGRERTKDEWKKLLEKAGFSRIEIVPICAIQSVIVAQP

SEQ ID NO: 1591 - protein, 365 aa, Glaucium flavum
MGSTENQMKNTQEDEEVEACKYAMQLASATVPAMVLKTAIELDLLEIITKSDLGAKLSSTEIASKIPNCKNPDAPVMLDRMLRLLASYNILTCSLREIEGGKVERIYGPAPVCKFLTKNEFGCSMAPLVLMNQDKVLMESWYYLKDAVLDGGIPFNKAYGMTAFEYHGTDPRFNKVFNKGMSDHTTITMNKILETYKGFEGLNSIVDVGGGIGATVNMIVSKYPTIKGINFDLPHVIEDAPAYPGVEHVGGDMFVSVPNGDAIFMKWILHDWSDEHSIKFLKNCYEALPQNGKVIIVECIIPISAECGERSHGVFHLDNIMLAHNPGGKERTEKDFEELAKKAGFKGFKVVCSAYETFVMEFTKN

SEQ ID NO: 1592 - protein, 353 aa, Glaucium flavum
MGVSDNKPESQEVDIKAQAHLWNIIYGFADSLVLRCAVEIGIADIIKSNNGSISVTELASKLPITNVNSDNLYRVLRYLVHMGILKEVSDSNEVKLYSLQPVATLLLRDAERSMVPIILGMTQKDFMIPWHFMKEGLGNDTTAFEKGMGMTIWQYLEGHPEQSNLFNEGMAGETRLLTKSLIDGCRDTFEGLTSLCDVGGGNGTTIKGIYDAFPQIKCSVYDLPHVIASSPEHPNIERIPGDMFKSVPSAQAILLKLILHDWTDEECVNILIKCREAVPKDTGKVIIVDVALEEESQHELTKTRLILDIDMLVNTGGRERSEDDWEKLLKRAGFRGHKIRHIAAIQSVIEAFP

SEQ ID NO: 1593 - protein, 348 aa, Glaucium flavum
MEATKSDQANQANIWKLIYGFAESLVLKCAIQLEIADTIHNHGEPMSLSELASKLPVQPVNSDRLYRVMRYLVHMKLFNKEKTSINGEFKYSLAPPAKFLIKGWEKSMVASILAINDKDFLAPWHHLKDGLSGDCDAFEKALGKSIWVYMSENPEKNQLFNEAMACDTRLVTSALVNDCQSVFKGINTLVDVGGGTGTAVKAISKAFPHIKCSIYDLPHVIADSPEIPNVVKIEGDMFKAIPSADAILMKCILHDWNDDECIQILKKCKEAVPQEGGKVIIVDVVLNMDLTHPYSKIRLTLDLDMMLNTGGKERTVEEWKKLIDAAGFASFKITEISAVQSVIEAFPY

SEQ ID NO: 1594 - protein, 365 aa, Glaucium flavum
MVKVDDRREDEEERLRGQAEIWDVMLAFVDSMALKCAVELGIPDIINSHGRAITLLEITNAIKTNSQLSSSPDINCLSRIMRLLVRKRVFSSQSHPEAGETDETMLYNLTPSSKWLLRDSEFSLVPMVLFEHNPRLMAPWHYLTKCVQEGGFAFEKTYGTQVWDYALANPDINKLLNDAMECTARIIVVTLLAAYKEGFDGIETIVDVGGGTGMVVIEIVKAHPHMRGVNFDLPHVVAAAPEFEGVKHVGGDFFVNVPHADAVIMKWVLHDWCDEDAVRILKNCRKAIPKDTGKVIIVDFVLKPDGKELFDHMGLVFDMLMMAHSSNGKERTEVEWKKLLNDAGFPTYKVIKIPTLGSIIEAYPY

SEQ ID NO: 1595 - protein, 356 aa, Glaucium flavum
MEIQMGDQEQEMKNQGLVWNKICGSVDSSVLKCTIELGLLDTINSSSSKPMITLSELSSTSPSLHSIKTQNLYRLLRYLTHMNLITINSTEATESFSLTDLAKLLLKTQERSLKDWVLGIDDEHSVNGWHELSSYCCSPDDAPTPFVKLHGKTLWELAEEVPEVNELINNGMACDTRMVMPAFVQGCEKVLSGIRKLVDIGGGTGAAISYVVKAFPQIKGTVLDLPHVVATAPEIPGVEMVGGDMFESIPHADALLLKFMLHNWKDEECIKLLKRCKEAIPTDQGKVIIIEMVLDQDEDDEDLTQARLSLDLDMMLSSGGKERTKDEWRVLLESAGFSRIEFIPIYAIQSVIVAYP

SEQ ID NO: 1596 - protein, 365 aa, Glaucium flavum
MGSTQNQFNATTEEDEEAQACMYAMQLASATVPVMVLKTAVELDLLEIIKKAGPGAQISSLEISSQIPNNKNPEAHVMLDRMLRLLASYKILTCSLKDLEGGKVERVYGLAPVCKFLTKNEVGCSMASLLLMNQDKVLMESWYHLKDAVLDGGIPFNKAYGMSAFEYHGTDLRFSKVFNKGMSDHTTIVMNKILETYNGFEGLKSIVDVGGGVGATINMIVSKYPTIKGINFDLPYVVQEAPTYPGVEHVGGDMFASVPKGDAIFMKWILHDWSDEHSVKILKNCYEALPENGKVIIVECIIPVIPDGTTSHGVFHLDNIMLAHNPGGKERSEKEFEALAKGTGFTGFKVVCSAFDTYVMEFSKN

SEQ ID NO: 1597 - protein, 384 aa, Glaucium flavum
METKGEARMNSCYISEAGHLGRLICLPMALRAAVELNVFNIISEFGPGAQLSSRDLVAKIPTTNPNAHVYLERILRLLAASSFLSVSTRTSSSPESITNTNGHHNGDTNGVVNHDNEKVTERVYGLTKESHCLVPRKDDGVSLVPMLMFVADKIVVESFYNLKEVVLQEGRVPFDMTHGASIFEYAGKDPRMNKVFNEAMGDFSVIAFDEVLKVYNGFLDMKELVDVGGGIGTSLSNIVTKYPFIRGINFDLSHVISSAPNYTGVEHVAGDMFEELPKAQNILLKWVLHDWDDKQCLKLLKTCWNSLPAEGGKVIVIEFVVPSKIADNPESYNALTPDLLMMALNPGGKERTLLEFYDLANAAGFAKAKPFPISEGLHVIEFHK

SEQ ID NO: 1598 - protein, 367 aa, Glaucium flavum
MGSTQDQFKPTPIEEEEEACMYAMQLASASVPVMVLKAAVELNVLEIIAKHGPGAQISASAIAAHIPNIKNPNAPVMLDRMLRLLASYKILTCTVKDLDDQGLVQQRLYGLALVCKFLVKNEDGCSMAPLLLMNQDKVFLESWYHLKDAVLDGGIPFNKAYGMNAFEYQGADPRFNKIFNRGMSDHTTITMKKILETYKGFEGLTSLVDVGGGIGVTVDMIVSKYPSIKGINFDLPHVIKDAPSYPGVEHVGGDMFASIPKGDAIFMKWILHDWSDEHGIKILKNCYEALPDHGKVILVECIIPPYPETSLAGLGVFHVDNIMLAHNPGGKERTEKEFEALAKGTGFAGFRVICSAFNTWIMEFSKN

SEQ ID NO: 1599 - protein, 353 aa, Hydrastis canadensis
MDANGNKDHESSDIKSQAHLWKIIYGFADSLVLRCAVELEIFDIIDNNNQPITVSELASKLPIADVNSDNLYRILRYLVQMKILKLNKVVDDGVNKYSLQPIAALLLRNSKRNMVPIILGMTQKDFMTSWHSMKDGLSNNGTAFEKGMGMTIWEYLEGHPEQSQLFNEGMAGETRLLTSSLISGSKDMFQSIHSLVDVGGGNGTTIKAISDAFPHIKCTLFDLPHVIANAYDHPNIERIPGDMFKSMPSAQAILLKLILHDWSDEDCIKILKSCKEAVPKDGGKVIIVDVALDEESDHELTSTRLILDIDMLVNTGGRERSKEDWEKLVKCAGFKGCKIRHIAAVQSVIEVFP

SEQ ID NO: 1600 - protein, 356 aa, Hydrastis canadensis
MEIKMEGVEGHELLEAQAHIWNHTFNFITSMTLKCAVQLGIPDIIYNHGQPITLSELVKALSIHQMKSDYLYRLMRILVHSEFFAIQKIHEDQEGYVLTPSSKYLLKNQLTNLSPYILMVLDPVLVTPCHFMSAWFQGNESTPFEVAHGMSFWEYCGQHPDIRKYFNKAMASDAELVMTVASKECKTMFEGFKSLVDVGGGTGTMAKAISKSFPHLKCTVFDLPYIVSNLQGSENIEFVGGDMFESVPPGDIFLLKLILHDWKDEECVNILKRCREAISLENKGGKVIIIDMIVDDNRGKYESTEAQLCFDMLLMVLVTGKERTESEWEKLFLEAGFTSYKITPALGLRSFIEVFL

SEQ ID NO: 1601 - protein, 347 aa, Hydrastis canadensis
MEINKENLSSQAQLWNFIYGFAESLVLKSAVQLDLANIIHNNTKPMTLSELSSHLPIQPVNPDHLYRIMRYLVHMKLFTKSSIDGEIRYGLAPPAKFLVKGYDKCMVGSILAITDKDFMAPWHYLKDGLSGESGTAFEKALGMNIWGYMAEHPEKNQLFNEAMANDTRLIMSALVKECKSIFEGVNTLVDVGGGTGTAVRNIAKAFPHIKCTVYDLPHVIADSPGYSEVTSLEGDMFKYIPNADAIMMKCILHDWDDNECIEILKRSKEAVPKEGGKVIIIDIVLNVQSEHPYTKMRLTLDLDMMLNTGGKERTEEEWKKLIHAAGFSGYKITQISAVQSVIEAYPY

SEQ ID NO: 1602 - protein, 355 aa, Hydrastis canadensis
MEITDGVEGHELLEAQAHIWNHTFNFITSMTLKCAVQLGIPDIIYNHGQPITLSELVKALSIPQTKSAYLYRLMHMLVHSGFFAVQKIHEDEEGYVLTPSSKILKKNHVTSLSPALLMVLDPVMVTPFHFMSTWFQGTESTAFEAAHGRSLWNYCGQNPGMSKCFDEAMASDSELVMSVVVKECKTMFEGLRSLVDVGGGTGTMVKGISEAFPHLKCTVFDLPHVVADMKGNKNMEFVAGDMFEYVPSADILLLKGVLHDWRDEECVNILKRCKEAISSKDKGGKVIIIDVVMDDSKEKYESTETQLCFDMMMMVIVSGKERSEIEWEKLFLEAGFTSYKITPVLGLRSIIEVFP

SEQ ID NO: 1603 - protein, 354 aa, Hydrastis canadensis
MALIEGEEIDVLLSGQNHLWKHLLNFINSMSLKCAIQLGIPDIIHHHGRPITLLELVSALSFPSSKTECVHRLLRMLVHSGFIDKQKNGDKEDQYSLTPSSKLLVKENPMNLSPLVLLILDPFIVTPFHFLSTWFSKTEPTPFEMVHGASVWELARQNIKLNNFFNDGMASDSGFLMSIAVKECGEVFDGLTTVVDVGGGTGTAAKAIAEAFPHVKCTIFDLPHVVATLPKNIMINSIGGDMFESIPSTDAIFLKWILHDWSDKDCVKILKQCKKAISSSDGGKVIIMDIVMNNNVKDQELSGTQICFDMLMMGVCGGKERNEEEWFKIFLDAGFTRYKIRAVLGVRSIIEVYP

SEQ ID NO: 1604 - protein, 356 aa, Hydrastis canadensis
MQIQEEEQEQEMKHEAQVWNHMSGIVDSVVLKCAIELNLFDTINNTTNNESITLSSLTTSLSLPSIKPHYLYRLLRYLAHMKLITIHVTQQNETFSLTELAKLLVKDEEKNLVDWAMIIIEVNSINGWHQLSDYCSCSSDEPTPFEKSHEGKSVWKIAGENSKMNQLINDAMDCDTKMFMPAFMQCCDKFLNGVTSMVDVGGGVGVAMSFIVKAFTRIKCTVFDLPHVIAAATEFPGVEFVEGDMFQSIPPTDAVFLKFMLHNWQDEECVKILKNCKEAIPKNKGKVIIIDIIIDEDEDDYHLSRAKMNLDIDMMVNSGGRERTKKEWELLLDLAGFSGHEIVPIMAIQSVIVAYP

SEQ ID NO: 1605 - protein, 364 aa, Hydrastis canadensis
MGSTQNQIFSTQEEEEEACNHAMQLASASVLPMVLKAAVELDVLEIIAKAGKGAYITPSDIASQLPTNNPDSTVMLDRMLRLLASYKVLNCTLRTLEDGRVERSYGLAPVCKFLVKNEDGVSICPLVLMNQDKVLMESWYHLKDAVLDGGIPFNKAYGMSAFEYHGTDPRFNKVFNKGMSDHSTITMKKILEIYKGFQGLKSVVDVGGGIGATVNMIVSKHPSIKGINFDLPHVIQDAPSYSGVQHIGGDMFVTVPNGDAIFMKWILHDWSDEHCLKLLKNCYKALPSDGKVIIVEAILPVFPETNLAANGVFQLDNIMLAHNPGGKERTEKEFEALSFGAGFTSFRVICCAFNTWVMEFCKNI

SEQ ID NO: 1606 - protein, 355 aa, Hydrastis canadensis
MDVQESGTNYLSGLGLSRLICLPMALRAAIELNVFEIISQAGSNAQLSSSEIVSKIPTKNPKASISLDRILRMLGASSILSISMNKDHQRVYGLTNESRCLVANEDKVSVVPMLLFTSDKAVVESFYLIKDVVLEEGVVPFDRAHGVDFFEYAGKEQRVNKSFNQAMGAGSTIAFDEVFKVYKGFEELKELVDVGGGIGTSLSNIVSKYPHIRGINFELPHVIADAPNYPGVEHVSGDMFEGVPNAQNILLKWVLHDWDDERSIKILQNCWKALPECGRVIVVEFVLPQILGNNAESFNALTPDLLMMALNPGGKERTTIEFGHLAKEAGFAETKFFPISQGLHVMEFHKKAATS

SEQ ID NO: 1607 - protein, 363 aa, Hydrastis canadensis
MEFQKIKITDGVDQTQDDFGCVMQFTTSAVLPMAMRAVIEMNLLEIMAKAGPNAQLSPSQIASQLQTQNPNAPMMLDRILRLLASYSLVTCSTVSHENGSVERFYGLAPKSKDLVKDEDGVSMSPMMMMILDKVCMESWYNLKDAILDGGVPFIKAHGVNSWEYPSRDPRFNHVFNIAMFNYTATAMKKILEIYKGFEGLKVLVDVGGGIGTSISMITSKYPAIKGINFDLPHVIQHAPSYPGVEHVGGDMFVSIPEGDSIMMKGILHDWSDEQCIKLLKMCYEVLPDHGKVIIAERILPVTIEDSVAAKDIFQFDLMMLTFHGGGKERTEKEFKIMGKEAGFSDNEIVCHLFNYWVIMEFIK

SEQ ID NO: 1608 - protein, 340 aa, Hydrastis canadensis
MHLTTSSVLPMVMKTVIELDLLEIIAKAGLGKQISPSEIASHLPTKNPNASMMLDRILCLLASYSVVTCSTISHENGEVERLYGLGPMSRYLVKDEDGVSMSAAMMIVVNKICMESWYHLKVAVLDGGIPFEKAHGINMFQYQDNDKGFKQIFQDSMSNYTIMVMKKILQTYKGFEDLKELVDVGGNTGSAISMITSKYPKIKGINFDLPLVIEQAPSYPGVKHVGGNMFTGVPKGENFFMKWVLHNWSDEHCLTLLKNCYEALPSNGKVIVVEMMAPTSIETDDSAKSFFQLDLIMMVQPGHGKERTLKEFETIAKEAGFASIKVVCCACNNWVMEFTK

SEQ ID NO: 1609 - protein, 361 aa, Hydrastis canadensis
MGSIKNQLKTDDENFSLVMQLITSSILSHGLQVAIELDLFEIIAKAGPNAKLSPRDIVSHLSTQNPDAPIMLDRILRLLVSYSILNSSIVTNQDGLVERLYGLTPVGEYFARNEDGVSMSPMMLLGHDKVFNDSWYYLKDSILEGGIPFNKAHGMHAFEYPRIDSRFNHLFNDAMFNHTTIIMKKIVDTYGGFEDLKELIDVGGGVGTTISIITSKYPTIRGINFDLPHVIEHAPTYPGVENVGGDMFASVPKGEAIFLKWILHDWSGESCLKLLKNCYKALPNQGKLIIVEAILPVATENDTAAKGICQMDLVMMTQNPGGKERTEEEFESMAKGAGFAGMKKVCRIYNYWVIEFYKHKH

SEQ ID NO: 1610 - protein, 355 aa, Hydrastis canadensis
MTSINNGNQLKTTNGQDEDFSHIMQFTTASVLPMAMRAVIEMDLLEIIAKAGPNAQLSPSQIASHLQTKNPDAPVMLDRILRLIASYSLITCSSVSHENGPVERFYGLAPISKYFVKDEEEVSVSPMILMVLDKVCMESWFHLKDAILDGGVPFKKAHGVDSWKYTGIDQKFNQVFNKAMFNNTSLIMKKILEKYNGFENVKGVVDVGGGIGTAVSIITSKYPAIKGINFDLPHVVQHAPSYPGVEHVGGDIFVSIPKGEAIFMKGIFHDWSDEHCKKILKNCSEALPEHGKVIVVERILPVVLETNTAAKDIFQFDLIMMTQHGVGKERLEKEFKAIAKESGFTCNIVCRLFNY

SEQ ID NO: 1611 - protein, 351 aa, Jeffersonia diphylla
MEVNGKTNEAVDIKAQAHLWKIIYGFADSLVLRCAVELGIADIIDNNNQPITLSDLASKLPLPSVNIDYLYRIMRYLVHMKLFKVEENINGVKQYSLQPTGTLLLRTAERNMVPMVLGMTQKDFVTPWHFMKDGLSDDGTAFEKGMGMTIWEYLEGHPDQSQLFNEGMAGETRLLTSSLISGCGDLFKGITSLVDVGGGNGTTLKGISDAFPHIKCTLFDLPYVIANSYDHPNIERIAGDMFQSVPSAQAILLKLILHDWSDEDCIKILKKCKEAVPKEGGKVIIVDVALDEESDHELTSTRLILDIDMLVNTGGKERTKEDWNKLVKAAGFRGFNIKHIAAVQSVIEVFP

SEQ ID NO: 1612 - protein, 351 aa, Jeffersonia diphylla
MEAKTGFEISSQANLWNFIYGFSNSLVLRCAVELDIANIIHNHGMPITLSELELLLPVQPVNTASLYRVMRYLAHIKIFTKTLDVDGETRYGLTPSAKFLVKGWDQCTVGAILGITDKDFMAPWHYIKDGLTGDSKKTAFEKALGMDIWKYMGDHPEKNKLFNAAMACDSRLAMSALINECKDKFQEITSLVDVGGGTGTAARNIAQAFPHIKCTVYDLPHVIADSPVYPELNSVAGDMFKCVPNADAIFMKCILHDWDDKECIEILKQCKEAVPKQGGKVIIVDIVLNMKSDHPYTKLRLTLDLDMMLNTGGGKERTEEEWKKLFQAAGFRGYNITQISALQSVIEAFPY

SEQ ID NO: 1613 - protein, 370 aa, Jeffersonia diphylla
MASLMDRETIDGDGGENLLEAQAHILNHLFNFISSMSLKCAVQLGIPDIIHDHHNQPITLSELVQALQLPKANSVFLYRLMRILVHSGFFARQKIHGIQEAQEEEGYILTPSSKLLLKGHPMSVSPLVLLVLDPALVTPWHVLSNWFQRSNELITPFEGVNGMNLWKYCGENQETGKLFDEAMACDSKLLMSVVMKECKVKFEGLRSLVDVGGGTGTSVRVIAEAFPAMKCTVLDLPHVVGTLQGTSNLEFVSGDMFEFIPSAQAILLKSIMHDWSDEECVKILNRCREVIPSKEEGGKVIIIDMVVNDKNKGNYESTETQLGFDMLMMVLLTGKERTEIEWEKLFLDSGFTSYIITPILGLRSFIEVFP

SEQ ID NO: 1614 - protein, 367 aa, Jeffersonia diphylla
MAQLMDRETIDGDGGEKLLEAQAHIWNHVFNFISSMALKCAVQLGIPDIIHSHHNKPITLSELVEALCIPKTTTTYVYRLMRILVHSGFFATQKIHVTQEAQGYVLTPSSKLLLKDHCMSMSPFLLAMLDPVLVTPWHFLSDWIQKSDELITPFESANGRNFWTYCGENRETGKLFDESMARDCELVMSVVLKECKEKLEGMRSLVDVGGGTGTMCRVIAEAFPGVKCTVLDLAHVVQPLQGSENVEFVSGNMFEHIPSADVVLLKLIMHDWSDNECVKLLKRCREAVLSEEQGGKVVIIDMVLDDKNEGNYESTKTKLIFDMLMMVLVTGRERTEIEWKKLFFDAGFSGYKITPILGLRSFIEVFP

SEQ ID NO: 1615 - protein, 357 aa, Jeffersonia diphylla
MDRESSNWDEGEELLEAQTHIFYHIFNFINSLSLKCAVQLGIPDVIDNHQHKPLSLFELGKALKIPQAKSAYLFRLMRVLVHSGFFATKRINGSKEEGYLLTPSSKLLLKNHPMSMSQYLLVVLDPVLVAPCHFFSDWFRMSDEVITPFEVRWKKSLWSYFGENQVMGKLFDESMACDSRLVMNVVLKKFKMKFEGLQSLVDVGGGDGTASRIMVETFPDMKCTVLDLPQVVGTFQGSENLEFVGGDMFQSIPSAHAVFLKWIIHNWNDEECLKILKRCKDAIPSKGGKLIIIDIVVDERSYKSTQSQLYLDMLMMILLTGRERTKLEWEKLFFNAGFSTYNITPLYGFRSLIEVYP

SEQ ID NO: 1616 - protein, 346 aa, Jeffersonia diphylla
MDTCNQSREEENIRAQAQVWKHMYGFANTIMLRCTLRLELPDIIHKHGPMTLSELASKLPFKSINLDRFNHIMRYLVHMKLFTIDTGKTHDQNKYRLTRASELLVKSHEKSLAPFAMLQTHPQEFSVWGQFIENLDGTMKYTEVYHDMDQDQEINKLVNEAMTSHTKCMVPALVSGLMKEKILDDITTLVDVGGSEGVASLAIIDVAPHIKCVILDLVHVIESVPNDPRLEFLPGDMFAFVPQSNAVLLKSILHNYDDENCLKILGNCKEAVSSTGGKVIIVDIVVDTENLPELSSARLSLDLEMLCMGGQERTKQEWKCLLHNAGFSHHNIVPIVAMESIIVAYP

SEQ ID NO: 1617 - protein, 348 aa, Jeffersonia diphylla
MDENQAKEDEEIQAQVLIWKYMYGFAETVMLRCALLLGLPDIIHQHGPMTLAQLASELPLSSVDINRFHHVMRYLVHMKLFTTTFQTTGEETYSATAASDLLLKDHEQSLSSYAMLQTHPETFSMWTHINESLDGSQAYWVSTYGASLYDKIENEPVHKKMVNDAMTSHTRSMSRALVSGLAKERLLDGVRSLVDVGGNSGQAAKAIKGSFPDVKCTVMDLAHVIDSVEHDPDLDFLPGDMFTMVPKADVILAKSILHNYEDDDCLKILTKCKEAIPEGKLILVEIVLDAKNLQELSFARLGMDMEMICMGGKERTKQEWDDLLKKVGFSQYKIIPMMAIESILVAYP

SEQ ID NO: 1618 - protein, 364 aa, Jeffersonia diphylla
MGSTQNQIKITDAEEDEACNHAMQLASASVLPMVLKAAIELDVLEIIAKAGPGAYVSPKEIASQLPTTNADAPVMLDRMLRLLASYKVLTCTLRSLENGQVERLFGLAPVCKFLVKNEDGVSIAPLVLMNQDKVLMESWYYLKDTVLEGGIPFNKAYGMSAFEYHGTDPRFNKVFNRGMADHSTITMKKILEVYKGFDGLKSLVDVGGGTGAIVNMIVSKYPSLKGINFDLPHVVDDAPSYPGVQHIGGDMFVSIPKADAIFMKWILHDWSDEHSLKFLKNCYEALPKNGKVIIAESILPVFPETNLAANGCFQLDNIMLAHNPGGKERTEKDFETLAKGAGFASFKVVCGAYNTWVMEFCKNI

SEQ ID NO: 1619 - protein, 354 aa, Jeffersonia diphylla
MDTKTGVNYLSGLGLSRLICLPMALRAAIELNVFEIIAQAGPAAQLSSSQILKKIPTNNPNATVALERILRMLGASLILSVSTNASNERVYGLTSESSCLVTKGDQVSVVPMLLFTADKAVVESFYMLKDVVLEEGCVPFDKAHGVNFFEYAGKEPRVNKLFNQAMAVGSTIAFDEVFKVYKGFDGMKELVDVGGGIGTSLSNIVSKYPNIRGINFELAHVIADAPNFPGVEHVAGDMFESLPSSENILLKWVLHDWDDERCLMILKSCWKALPESGKVVVVEFVLPQILGNNAESFNALTPDILMMALNPGGKERTIVEFSDLAKASGFDEVKPFPISQGLHVIEFHKTKSNT

SEQ ID NO: 1620 - protein, 358 aa, Jeffersonia diphylla
MGSQDNKLIATMEEDDFSPSLWLTTASVMPMVMRAVVELDVLEIIAKGGQVTSLQIASELPTQNPEAPMMLERILRLLASYSILTCTSATSEDGSVERMYGVGPACKYFLRNQDGVSMSPMVLMALDKVFTESWYHLKDAILDGGIAFNKGHGMSSFEYTGTDQRFNRIFNVAMYNYSSIVMKKVVEIYKGFDDLKEVIDVGGGIGTAISIITSKYPNIRGINFDLPHVIEHAPPSPGVEHIGGDMFSSVPKANNIFMKGILHDVSNERCLTLLKNCYDALPNNGKVIALEMIVPKEIESNPTVQNIFHFDLIMMVQHYGKERTEKELELIAKEAGFAKIKLVCRVFIYWVIEMIKMT

SEQ ID NO: 1621 - protein, 350 aa, Mahonia aquifolium
MELNGKDESVDIKAQAHLWKIIYGSADSLVLRCAVELGIADIINDNNQPITLPDLASKLPLSNVNIDHLYRILRFLAHMKLIKQEEKQGVTLYSLEPIGTLLVRNAKRNMVPIILGMTQKDFMTSWHFMKDGLSNDGTTAFEKGMGMTIWEYLERHPEQSQLFNEGMAGETRLLTSSLINGCRDMFKGINSLVDVGGGNGTTIKAISDAFPHIKCTLYDLSHVVANSYDLPNVERIPGDMFQSVPSAQAILLKLILHDWSDEDCIKILKKCKEAVPKEGGKVIIVDVALDETSDHELTGTRLILDIDMLVNTGGKERSKEDWDKLVKAAGFKGFNIRHIAAVQSVIEVFP

SEQ ID NO: 1622 - protein, 349 aa, Mahonia aquifolium
MGEENIANQAKLWNIIYGFADSLVLRCAVELDIANIIHNHGKSMTLSELASVLPVKQPVNSDSLYRVMRYLAHLRVFTKTLDADGETRYGLAPPANFLVRGNDNCMVGSLMGLTDKEFMAPWHYIKDGLSGDDGKTAFEKALGMDIWEYMGENPEKNKLFNEAMACDTRLVLSALINECKDKFQGLNSLVDVGGGTGTAARNLAKAFPHLKCTAYDLPHVIADSPVYPEITQVPGDMFKVIPYADAILMKCILHDWGDKECIQIVKKCKEALPKEGGKVIIVDIVLDVKSEHPYTKLRLTLDVDMMLNTGGGKERTEEEWKKLIQAAGFKSYNITQISALQSVIEAFPY

SEQ ID NO: 1623 - protein, 345 aa, Mahonia aquifolium
MEALNGCTNHFEDDEDLSAQALVWNHMYGFANTIMLRCTLRLKLPDIIHKEGPLTLSQLASKLPFNSINLDRFNHIMRYLVHMKLFKIVNKDKYALTRASELLVKSHEKSLAPFAMLQTHPQEFTYWGHFIENLDKAKNYTELYHEMDNDPEINKLVNEAMTSHTKCMVPALVSGLTKENVLADVKSLIDVGGSEGIASKAIIDVVSHVKCIIMDLAHVIDTVPKDPRLDFLAGDMFDFVPKADAVMLKSILHNYDDDNCLKILTKCKEAIPTKGGKVIIVEIVIDTQNLPEFSSARLGLDMEMICMGGQERTKQEWATLLHKAGFDHHTIIPIRAIESIIVACP

SEQ ID NO: 1624 - protein, 363 aa, Mahonia aquifolium
MGSTTHIPIKITAQEEDEACNHAMQLASASVLPMVLKAAIELDVLEIIAKAGPGAYISPAEIVSQLSTTNPDALVMLDRMLRLLASYKVVTCTLKTSEGGEVERLYGLAPVCKFLVKNEDGVSIAPLVLMNQDKVLMESWYHLKDTVLDGGIPFNRAYGMTAFEYHGTDPRFNKVFNKGMADHSTITMKKILEVYTGFDGLKSLVDVGGGTGAIINTIISKYPSIKGINFDLPHVIGDAPSYPGVEHVGGDMFVSVPKADAIFMKWILHDWSDEHSLKFLQNCYNALPSDGKVIIAESILPVFPETDLAANGVFQLDNIMLAHNPGGKERTEKDFEGLAKKAGFSGFKVVCRAYGTYIMEFSK

SEQ ID NO: 1625 - protein, 382 aa, Mahonia aquifolium
MSLFSRYAPQLATSNHIHNQSQTTLTMATQESPSYLSGLGLSRLICLPMALRAAIELNVFEIISQAGPKAQLSSSQILTKIPTKNPNGAIAIERILRLLGASSILSVSTNSSNQRVYGLTNESLTLVPRADQVSVVPMLLFTADKAVVESFYMLKDVVLDEPGCIPFDKTHGMNFFEYAGKEPRVNKVFNQAMAVGSTIAFDEVFKVYNKGFDGMKELVDVGGGIGTSLSSIVAKYPHIRGINFELDHVIADAPTYPGVEHIAGNMFEGVPSAQNIMLKWVLHDWGDEQGLIILKNCWKALPENGKVIVIEFVLPEVLGNNAESFNALTPDLLMMALNPGGKERTIVEFSELAKAAGFEEVKPFPISQGLHVIEFHKTKACA

SEQ ID NO: 1626 - protein, 355 aa, Menispermum canadense
MILDNHDKAEEALVVDVHDQAHLWKLIYGFVDTLVVRSAVELGIMDIIYNNKKPISLFDLASKLPVSNTCPDRLYRILRYLVHVRLLRVAEVDGLKKYLLAPAAKLLLRNTEKSMVPIILGMTQKDFVVPWHHINDGLGSEGATAFDKSMGMSFFEYLEENPSQSKLFNEAMAGETRLLTASLINGCKDLFQGIESLVDVGGGNGTTIKAISDSFPHIKCTLFDLPYVVADSHDDPNIKRVHGDMFKSIPSSQAILLKLILHDWSDEDCVKILKRCKEAVPKEGGKVIIVDVALDEESQHELSSTRLILDIDMLVNTGGKERSKEDWEKLIKCAGFGGYKIRHIAAIQSVIEVFP

SEQ ID NO: 1627 - protein, 350 aa, Menispermum canadense
MDTTINGSLLEADHNLQVKAQAHVWNTIYRFSDSLILRAVIDLGILDIINSNNNSISLSELASKLPLHHVHHDHISRILRHLTHMKILRVVTADDDGDDNMITKYSLEPLVAALLLKSSEKSLAYNVLGMIQKEFVLPWHYIKDCLVGCDESTIFTTPFEKAMGVTFWEYLEGHLEDSKNFNESMASETRLLTASLIDGCRDVFESVGSIVDVGGGNGTTLKAISNEFPHIKCTLFDLPYVVANACDCPGIECVSGDMFKAIPSAQAILLKLILHDWGDEDCVKILKRCKEAVPSDVGKVIIVDVALEEDFEDELTGARLALDMDMLVTTGGKERTKEDWEKLVKRAGFR

SEQ ID NO: 1628 - protein, 356 aa, Menispermum canadense
MEAPSTLKQDQAAQAKLWKFIYGFAESLVLKCAIQLDIPDIIHSHGQPMTLTHLASRIPSSQSVDDDRLYRIMRYLVHMKLFTKESGGDDGEDRYGLAPPAKYLVKGWEKSMVPSILCITDKDFMSPWHHLKQGLVDDDEGNHRTAFEKALGVNIWDYMSENPKKNKLFNEAMACDTRLIMSALVNECKEVFEGVQSLVDIGGGTGTAVRNIAKAFPHIHCTVYDLPHVAADSPSYPEVTRVEGDMFKYIPSADAILMKCILHDWADKECIQILKKCKEALPIDGGKVIIVDIVLNAKSEHPYSKMRMVMDLDMMLNCGGKERTEEEWKKLIYGAGFSRYNIRQVNALQSVIEVYP

SEQ ID NO: 1629 - protein, 347 aa, Menispermum canadense
MEAEKYERSAQATVWNFIYGYTETLVLKCAVQLDIPTIIHNHGKPMSISQLSSHLPNQPIDQDRLYRIMRYLVHLKFFTKWLIEGETRFGLAPPAKFLIKGWDKSMVPIVLAMTDKNYMASWHYVKEGLVGDKVALEKALGMGIWDYMADHPEMSQRFNEAMASDTRLVTSALVSEECKGVFEGIASLVDVGGGTGTALRSIAKAFPNVKCTLYDLPHVISNSPRYPEISCVEGDMFKYIPRADAVLMKCILHDWGDKECIEILKRCKEAVPRDGGKVIIVDIVIDTQSTHPYTKMRLTSDLDMMLNTGGKERSEEEWKNLILAAGYSGYNITQISAVPSVIEAFPY

SEQ ID NO: 1630 - protein, 356 aa, Menispermum canadense
MAEEAVREQEETLRGQAEIWECMFSFAESMALRCALELRIPEIINSHGRPMTISQITKKIINSPSQPDPNCLSRIMRLLVRKRVFTAAAAGQEVVYGLTRSSKWLLRDSESELSLAPMALMETHPQLMAPWHWFGKCVEEGGVAFEKAHGSEIWDFASVQPEFNNLFNRGMECTAKIVVKAVLEGYREGFDGLETVVDVGGGTGMMIREIVTEHPHLKGINFDLPHVVATAPDHPNVVHVGGDMFVEVPRADAVVMKWIMHDWSDEDCIQILKNCRKSIPEKSGKVIIVDAVLRPEGDGLFDYTGLVLDLLMIAHSSGGKERTEEEWKALLKAGGFPRYKIIQIPTLPSIIEAYPL

SEQ ID NO: 1631 - protein, 341 aa, Menispermum canadense
MEEEMKAQGQVWRYVYGFAESMTLKCAIQLGIPDILHQHGRPMTLSELADSLPLPTVNQDRLFRVMRYLVHMGLFDLVDSDKKYALNPASNLLIKGQDKSLASFALLQYYEMDAWHHLSAAVEGDVTPWEKCHGVDYREYFAKDSVANQLLSDAMTSHTSMVTEALVEGCKKAKVLDGVGSFVDVGGSTGVAARAIAKAFPGVKCAVFDLPHVIATAPECADVDRIEGDMFVSVPETDVVFMKSVLHDWGDEDCVKILKKCKEAIGGRKEGKVVILDIVLDAESSYEFKGARLGMEMDMLVTVGGKERSEEEWQKLFKAAGYSRYKITPIVAIESIIEVFP

SEQ ID NO: 1632 - protein, 369 aa, Menispermum canadense
MMNMSERNPKDEEEEGKKEEIIKGQAQLWKHMYGFLDTIVLRCAVQLGIPDLIHEQGPMTLHELANKLPIDTINMQRFHQTMRYMVHMNLFTVMMAKDDEVMVTKYGLTPASKLLLKHDNNNNNKISMASYVMLQTEPHEFSMAEKLVESLGSGTKTCWDLFYGIVPYEKMEEDPESTKMMIDAMTSSTTCMVQALVEGLMRENVLEDVTSLVDVGGNTGDVAKAILSAFPHLKCTVMDLLYVIQSVPKVPQLDFVAGDMFHSIPHADVVLLKSVLHNYEDDTCIKILNKCKEAIGPTRGKVILVEIVVDIENMPEFSAARLGLEMDMMFMGGKERTKKDWENLFYNAGYSYHRIIPIAAVESIIVVYL

SEQ ID NO: 1633 - protein, 356 aa, Menispermum canadense
MAGKQDGGVNYLGGLGLGRLIALPMALRAAIELNVFQIISDAGPEAHLSPSEIVAKIPTTNPNAPTALDRILRMLGASALLSVTVRAPSGDRAYGLTSESLSLVPNKEGVSAVPMLLLVSDQAVVKSFFGLKHAVLEEGCVPFDKLHGMNFFEYAGQEPRVNQVFNDAMAVSSTISFDEVYKVYKGFDEVRELVDVGGGLGTSLSSIVCKYPKISGINFDLSHVIADAPPYPGVKHVAGDMFEGIPSAQNILLKWVLHDWGDEYCAKILKNCFQALPDGGKVIVVEFVLPSVLGNNVETFNALIPDLIMLNLNPGGKERTIVQYEDLARAAGFSEFKPFPISQGLHVLEFLKKGSN

SEQ ID NO: 1634 - protein, 370 aa, Menispermum canadense
MDSTEHCQAKPSNEDEDFLFAMQLVNASVLPMVMRAAINLDVFEIINRYGKDSRLSASQIASRMTSHHHPQTPVMLDRLLRLLASYSVLTCSVNVANQESDDDQVIETLYGLTPACKYFVKNEDGFSLSPYLIYAQDKVSLDSWYQLDDAVVKGGFSFDKVHGMGQFQLLGKEPRMNELFNRAMSNHTTIVMNKILERYKGFEGLKVVIDVGGGTGTNTNIIVSKYPTVKGINFDLPHVIQSAPSYPGVEHVGGDMFECVPKGDAIFMKWILHNWSDERCLALLKKCYEALPDEGKVIVVEGILPAVPEANTANEVVYQMDLIMMTKHSGGKERTVEEFEALAKASGFAGLRLICCAYNYWVMEYYKSVI

SEQ ID NO: 1635 - protein, 361 aa, Menispermum canadense
MHMEEQDQDQEMQWQAQVWNHVAGGFVDSIVLKCAADLAIFDAIHNIQTKQTKPVALSALTSHFSSINTQKLYRLLRYLAHMKLLTITQSPFDDNEEYEITVSITELAKFLFRHNEKNMVDWALGVPDQPAVVAWHQLSNCIASEEPAPFKKEHGKSLWEFARDNPEMNKVFNDAMACDTRLVMPAFVEGCKEILKGVGSLVDVGGGTGTAMSYVVKAFPHVKCTVFDLPHVIRTSPEYPGVELVGGDMFQSVPHADVVLLKFMLHNWQNEGCVKILKKCKEAVLPSEKGKVIIVDVVIDQDEEDDDLTHVRLSLDMDMMAMSGGRERTKEEWRVLMEMAGFSGYEFIPIYAMQSVIVAYP

SEQ ID NO: 1636 - protein, 367 aa, Menispermum canadense
MGSTQNQLAAMTLSAEDEEEACMYAMQLASASVLPMVLKAAIELDVLEIIAKAGPGAHVAPSQIVAQLPNCTNPQAAVMLDRTLRLLASFRILTCKLDEGGERVERTYGLGPVCKFLVKNEDGVSMAPLVLMNQDKVLMESWYHLKDAILDGGIPFNKAYGMTAFEYHGTDPRFNKVFNRGMSDHSTITMKKLLETYKGFDGLKSVVDVGGGIGATLNMIISKHPTIKGINFDLPHVIEDAPSYPGVEHVGGDMFVSVPKGDAIFMKWILHDWSDGHCAKFLKNCHEALPDDGKVIIVESILPEFPETNLAANGSFQLDNIMLAHNPGGKERTAKDFEALAKGAGFVGFNVVCGAYNSWVMEFCKKL

SEQ ID NO: 1637 - protein, 348 aa, Menispermum canadense
MEDSSAFKVMELLGLGPLQMSLKAAIELKVLEILHKAGPESKLSASQIAAQLPTTNPTASTALDRILSLLASNSILSSTTAGENGERLYGLTPICKYFVSNQDGASLAPLFLFFHDKVLMESLSNLKDCVLEGSVPFDKAFGMNIFDYLGADERFRKVFSFGLSNHSITVMRDLLENYKGFEGVKEVVDVGGGIGASLKMIVSKYPHIKGTNFDLPHVIADAPSYPGVKHVSGDMFERVPNCDAIFMKFIFHAWDDKHCEVLLKNCWNALPEHGKVIMVEFALQTNIEIDSASRLAFTADLMMLAYREGGKERTIAEFEALAKRTGFATMKAIPCSLGMVALELHKRS

SEQ ID NO: 1638 - protein, 361 aa, Menispermum canadense
MASIQNQPITSNNEEEDFLLAMQLGSSSVLPMVLQAAIKLEVLEIIAKAGPGAKLSPKEIASQLPTQNPESPAMLDRMMRLLASYSVLTSTVMTHDNDQVERLYGLAPVCKYFVRNEDGDSLSPWMFLIQDKVFMDSWYNLKDAVFEGGVPFNKVHGVHAFQYPGIDPRFNQVFNGAMFSHTSIVMKKILEIYKGFEGLKEVVDVAGGIGTTMSIITSNYPTIKGVNFDLPHVIEHAPCFPGVTHVGGDMFSSVPKGEAIFMKWILHDWSDEYCLKLLKNCYDALPSNGKLIVVEAILPVAPETDAAAKSLCHIDLVMMTQNPGGKERTYEEFDAMAVGAGFAGIRKVCCVYNYWVMEFYK

SEQ ID NO: 1639 - protein, 357 aa, Menispermum canadense
MQALTQSPAHHEGDEEEEQVFSMALLLVHSPLLSMAMQAAIELDLFEIIARAGPGALLSASEVAAQVPTHNPKAPFMVDRILGFLASHSVLTCSFNNDNTERLYGLTPLCKYLVRDEDGGSLAPLARTDRAILDAGLHLKEAVLEDVLPFEKVHGVSFFEYMGKKDHRLFKAPDFNYTKIVTKKILKIYNGFENRKQVVDVGGSYGTVIRMVTSKYPSIKGINFDLPQVIGRLPPIPGVKLVGGDMFVSVPNGDTIILKSILHDWNDEQCVTILKNCYKALPEDGMVIVLEMILPTTLETNASAKEVRNMDLMLMLLGGQERTEKQYEALAKAAGFAHMKLVCCAFNFWVMEFNKKM

SEQ ID NO: 1640 - protein, 358 aa, Menispermum canadense
MDSTKNQLESTMEEEKDLLFALELVGASTITMVMWAAAELDLFEIIAKAGPGAQLSSSEIAAHIPTQNPEASDMLDRILSFLASHTVLTCSVVSHEDGLVKRVYGLAPVSKYFVKDENGGSFVSLLTLVKTVKDVWYHLKDAILEGGIPFHKVHGMSLFQYLGKEPEQNQPFHSHSFNLTDMIMTKVLKTYKGFDDLKEVVDLGGGLGTTIRMITSMYPNIRGINFDLPHVIARAPPIPRVEHVGGDIFGSIPKADAIVMKNILHMWKDEQCSVILKSCYEALPDNGKVIVIEIIRPTIPNSDAASKSAYRLDVTMMLHGGMERTEVEFETLAKSAGFAGIKLACHAYSWVIEFCKNL

SEQ ID NO: 1641 - protein, 351 aa, Nandina domestica
MAMNGKANEFEDIKAQAHLWKIIYGFADSLVLRCAVELGIADIISNNNKPISLSCLASKLPLPHVNLDHLYRIMRYLVHMKLLKLVVNENGEKLYALEPISTLLLKDAKRNMVPMVLGMTQKDFVTPWHYMKDGLSDDGTAFEKGMGMTIWEYLQGHPDQSQLFNEGMAGETRLLTSSLISGCGDLFKSLTSLVDVGGGNGTTIKAISDAFPHIKCTLFDLPYVIANSYDHPDIERISGDMFKSVPSAQAILLKLILHDWSDEDCIRILKQCKEAVPKEGGKVIIVDVALDEESDHELTSTRLILDIDMLVNTGGKERTKEDWDKLVKAAGFRGFNIRHIAAIQSVIEVFP

SEQ ID NO: 1642 - protein, 350 aa, Nandina domestica
MEVMKEQDVSAQAKMWNYIYGFSETLVLRCAVELDIANIIHNHGKPITLPELASKLPRQPVNSDSLYRVMRHLAHMKLFTKTKVDGDTKYELAPSAKFLVKGADKCMVGALLAITDKDFMAPWHYIKDGLTGDSKSTAFDKALGMDIWTYMGKHPEKNQLFNEAMACDTRLAMSALVNECKDKFNGIKSLVDVGGGTGTAVRNIAKAFPHIKCTVYDLPHVIADSLAYPEINRIAGDMFKSVPKADAILMKCILHDWADEECIEILKKCKEAVPEDGGKVIIIDIVLNVESDHPYTKMRLTLDLDMMLNTGGGKERTEEEWKKLIQAAGFRSYNITQISAVQSVIEAFPY

SEQ ID NO: 1643 - protein, 367 aa, Nandina domestica
MERGLINEDGGEEVLQAQAHVWNHMFNYISSMSLKCAIQLKIPDIIHNHPHKPITLSELSKELQIPTKKSSYLYRLMRVLVHSGFFAIQKIHGTQEQLEDEGYVLTLSSKLLTKTHPGRVTPLLQLMVDPAMVKPWYFMSDWFQSSDDVINPFDAAYGMSYWEYCGENQEFGKVFDEAMACDSQAVMSVVLKECKLKFEGVKSLVDVGGGTGTVGRLIAQAFPSIKCIVFDLPQVVATMQGGQNVEFVSGDMFESIPSADVVLLKCITHDWSDEECVKILKRCRDAIPSKEEGGKVIIIDMVVDDSKNRGNYESTETQLFFDMLMMVLVTGRERTEIEWEKLFLDAGFSSYNITPILGVRSFIEVFP

SEQ ID NO: 1644 - protein, 331 aa, Nandina domestica
MSLKCAVQLGIPDIIYNHPHKPITLFELVKALQIPKTKFPYVYRLMHILVHSGFFAIQEAHETQEEGYILTPSSKLLLKGNAKSMSAFVVMVLDPMLVMPSCFLSDWFQRSDEITPFEATGGTSFWKYGAENEQFGKLFNESMACDTQLVMSIVLKECKSKFEGLKSLVDIAGGTGTVGRMIAEAFPGVKCTVFDAPHVVGALQGTKNLDFVSGDMFESIPSADVLLLKWIMHDWSDEECMKILKKCKKAIPSKEEGGKLIIIDMVVGDSNNRGNYESTETQLLFDMLMMVVLPGKERTEVEWKKIFLDAGFSSYTITPVLGLRSLIEVFP

SEQ ID NO: 1645 - protein, 354 aa, Nandina domestica
MAQEQEVERLAATLQGQADIWQYMFAFVDSMALKCAVELGIADIINSHGTPITLTKIIQGIDAPSPDISYLSRIMRLLVRKRIFSAQPNGVDTLYGLTESSKWLLKGTEFSLAPMLLAENHPMLLAPWHYLSKVVEEGGVAFAKAHGKEIWELASENEELNKVFNQGMACTSKVTVKAIFSVYRDRFEGVRTLVDVGGGTGRMIGEIVKQHPNVTKGINFDLPHVVATAPEYPGVEHVGGDMFAAIPQADAIIMKWIMHDWSDEDCIKILKNCHEAIPKKTGKVIIVDVVLHPEGESLFDGTRLAFDLLMIAHASGGKERTENEWKNLLENGGFPRYKIFQLPTVPSIIEAYPE

SEQ ID NO: 1646 - protein, 339 aa, Nandina domestica
MKAQALLWKYIYGFTESLSLKCAIQLGIADTLYEHGQPMSLSELASSLTQPSINQERLFRLMRFLVYMKLFNRDDSQGVTKYSLTPESRLLVKSQDKNLASFGLLQYYEMDAWHHLSAAVEGGVTPWERCHGVEYRKYFANDSVANRLLSDAMTSHTSMVTDALVRGCVENGVLDGVRSLIDVGGSTGVAARAIAMAFPEIKCAVFDLPHVIANAPECAEVNRIGGDMFVSIPKTDVVFMKSVLHDWGDEDCVKILKKSKEAISESKQGKVVIVDIVMDMESSDEFTGARLGMEMDMLVTVGGKERSKQEWEKLFKSAGYSRYKITPIVAIESIIQVFP

SEQ ID NO: 1647 - protein, 353 aa, Nandina domestica
MSTIEKYFLLNQVDEENEEIRAQAQVWKHMYGFADTIMLRCALRLELPDLIHKYGPMTLSELASKLPLKSINLDRFNHIMRYLVHMNLFSIDMEKAYDQRKYTLTRASELLVKSHEKSLAPFAMLQTHPQEFSLWGHFIENLDEAKQYMEVYHDMDHDEECNRLVNEAMTSHTKSMVSALVMGLKKERILDDIKSLVDVGGSEGIALKAIMDVGSHVKCIIMDLAHVIDSVPKDPRLDFLAGDMFGFVPQADAILLKSILHNYDDDHCLKILSKCKEAIPETKGKVIIVETIVDTENLPEFSSARLGLDMEMLCMGGKERTKKEWECLLHKAGYSHHKIIPIMAIESIIVAYP

SEQ ID NO: 1648 - protein, 355 aa, Nandina domestica
MEAKSRVWELMYGFANSMTLRCALQLGLPDLVHKNGGPMTLTQIVNSLPIRGSPDPHRVYRIMRFLVQNNLFTCTKDDGSGELKYGLTAESELLVKDNEKSLAMYALLVLCPAQITAWQHLIDGLDSSTYTWMELHKMTWQESAVKDPQLLKLYNQSMTGYSSHVVEALVSGCARENVFDNSVHSILDLGGNTGIVAKAIVDAFPDIKCTVMDLPEVIAGPHVDHPCIVYMAGDVFSFVPKADVIFMKSFLHGYSDKECLKVLKKCKEAIPPEIGKVVLVEIAIDVNGFSKYSTAKLCMDMEMMIVGGKERNQEDWKDILDKAGLLVSIKFISIDAVESIIEAPPLSLNLRLPFK

SEQ ID NO: 1649 - protein, 341 aa, Nandina domestica
MDAKSRVWELMYGFANSMTLKCALQLGLPDLVHQNGGPMTLTQIVNSLPIQGFPDPDRVYRIMRFLVQNNLFTCTNDDGSGELKYGLTAESELLVKDSEKSLAMFVLHVLDPTQITAWQHLINGLDSSTYTWMEVYKKTWHESAVNDPQSLKLYNQAMTGYISHVVEALVSGCAREGVFDDSVHSILDLGGNTGIAAKAIVDAFPDIKCTVMDLPEVIDGPHIDHPRIAYMAGDAFSFVPKADVIFMKSFMHGFSDEECIKVLKKCKEAIPPEIGKVVLVEIAIDVNGFSKYSMAKLCMDMEMMIVGGKERNQQDWKMLKAGFSQKFISIDALESIIEARP

SEQ ID NO: 1650 - protein, 364 aa, Nandina domestica
MGSAPDLIKITAEEEDEACNHAMQLASASVLPMVLKAAIELDVLEIIAKAGPGAYVAPNEIASQLSTSNSDAPIMLDRMLRLLASYKVLTSTLRTLESGKVERLYGLAPVCKFLVKNEDGVSIAPLVLMNQDKVLMESWYHLKDAVLDGGIPFNKAYGMTAFEYHGTDPRFNKVFNKGMADHSTITMKKILQVYKGFDGLKSVVDVGGGTGAIVNMIISKYPAIKGINFDLPHVVEDAPPYPGVEHVGGDMFVSVPRGDAIFMKWILHDWSDEHSLKFLKNCYKALPEDGKVIIAESILPVFPETNLAANTVFQLDNIMLAHNPGGKERTEKEYAALAKGAGFAEFKVVCGAYSTWVMEFCKKI

SEQ ID NO: 1651 - protein, 352 aa, Nandina domestica
MATEQGANYLSALGLSRLICLPMALRAAIELNVFEIIAEAGPKAQLSSSQIITKIPTKNPKASIALERILRLLGASSILTVSTNSENQRVYGLTSESSCLVTKGDQVSVVPMLLFTADKAVVESFYMLKDVVLEEGCIPFDRTHGVNFFEYAGKEPRVNKVFNQAMAAGSIIAFDQVFKVYKGFEGMKELVDVGGGIGTSLSNIVTKYPHIKGINFELDHVVADAPNYPGVKHVAGNMFEEVPNSENILLKWVLHDWDDERGLIILKNCWKALPENGKVIVVEFVLPQVLGDNAESFNALTPDLLMMALNPGGKERTIVEFSDLAKAAGFAEVKPFPISQGLHVIEFHKTKA

SEQ ID NO: 1652 - protein, 371 aa, Nandina domestica
MHVPETTPNQHNTSNKKPYQMEAQDGPNYLSSLGLSHLICLPMALRAAIELNVFEIISQAGPNAQLSSSQIVTKIPTKNPKASIALERILRMLGASSYLSVSTNSSNQRVYGLTNVSTCFVAKGDQVSVVPMILFTYDKAVVESLYMLKDCVLEEGCIPFDRTHGVNFFEYVGKEPKVNEVFNRAMAAGSSVTFDEVLKVYKGFEGMKELLDIAGGNGTSLSTIVSKYPLIKGINFDLGHVIADAPNFPGVEHVAGDMFEGIPNSQNIMLKWVLHDWDDDRSLKILRNCCKALPDNGKVIVIEWVLPSVMGNNAEFCNALTTDVFMMALNPGGKERTIAEFSDLARATGFAEVSPFPISQGLCVIEFHNKN

SEQ ID NO: 1653 - protein, 354 aa, Nandina domestica
MANNGEDDFLLAMQIANTLALPMVMQAILDLEVLEIIANAGHGAQLSPSEIASHLSTKNPKAGDMLDRMMRLLACYSILTCSVVTHANGVVERVYGLAPVCKYYIKDENGVSFAPFLELMHHNDIMQGWYHIKDAVLEGGVPFDKAHGMDAFQYYGTKPKLNDLINRVQLIHTTTIASKVLEIYKGFEGLKEVVDVGGGLGIMINSIVTKYPTIKGINFDLPQVIEHAPSYPGVEHIGGDMFATIPKGEAIFMKYILHDWSDEHCLKLLKNCYEAIPDHGKVIVVETIAPLIPKNDITAIVPCQEDVIMMAEMPGGKERTEKEFEKLAMEAGFAGIKFVCPTCSYWVMEFCKMM

SEQ ID NO: 1654 - protein, 332 aa, Nandina domestica
MDSTQNQIRIKITAEEEDEACNHAMLLASASILPMVLKAAIELDVFEIIAEAGQGAYVAPSEIASQLSTSNTTAPIMLDRMLRLLASYKILSSTLCTVDSGRVERMYGLAPVCKFLVKNEDGVSIAPLVLMNQDKILIESWYHLKDAVIKGGIPFNKAYGMSAFEYHGTDPRFNMVFNKGMADHSTITLKKMLQLYDGFDGLTSLVDVGGGIGAIVNRIVSKYPTIKGINFDLPHVLEDAPSYPGIEHIGGDMFVDIPQGDAIFMKWILHDWSDEYCLEILKNCYKALPLDGKVIIVESILPVFPETNLAAKNVFAADNIMLAHNPGGKRED

SEQ ID NO: 1655 - protein, 349 aa, Nigella sativa
MAFYANDEALDVEAQAHVWKIIYGFADSLVLRCAVELEIFDIIGNNNSIQLSELASKLPVANVVPDHLYRLLRYLIKMELLRLETSNKGVKEYTLQPTARLLLRNEKRSMVPMILGNTQKDFMTPWHSMKDGLGHSGTAFEKSKGMTIWEYLETHPDQSQLFNKGMAAQTRLLTSSLISVNKDIFQSINSLVDVGGGNGTTIKAISDAFPHIQCTLFDLPHVIANSYDHPNIQRIGGDMFKSVPSAQAILLKLILHDWSDEDSIKILKQCKAALTENGGKVIIVDVALDEDSDHELSSTRLILDIDMLVNTGGRERTKEDWERLVKSAGFSGCNIRHIAAIQSVIEVFP

SEQ ID NO: 1656 - protein, 354 aa, Nigella sativa
MEEMINGDESKEILKAQAHIWKYTFNYITSMSLKCAVQLGIPDIIANHGKPLNLSQLVNELSIPHLKSPHLYRLMRILVHSGFFAIEEGEGYVLTPSSKLLLSKNQNTNLSPFVLMMMDPVLVTPFHFLTDWFQGNQTTAFKVAHGMEMWDYYGQHSDVNKSFDDSLAGDSGLVMGVVLKHWKEMFQGFGSLVDVGGSTGSVAKAISEVFPLMKCTVLDLPHVVSDMKGSKNLEFISGDMFEYIPPADIILLKWIMHDWSDEKCIKILKNCKEAISEHKGGKVVVIDIILDEDQGLRRNDSVETQLCLDILMMVSHAAKERTEAEWKKLFLDAGFSSFKVTRGLGLRSIIEVFP

SEQ ID NO: 1657 - protein, 364 aa, Nigella sativa
MTHGNEAKREMMNENRAKEILEAEANVWKYTLNYITSMSLKCALELGIPDIIASHDKPLTLSELVKALSIPQTKSAHIYRLMRLLVHSGFFAVENVLQDEECYILTPSSKLFLKNSNTNLSPFSLIMTDPLFVTSCSSLSAWFHSTSDYTPFESAHGNDFWSYLEQHPDSNKDFNDAMASDAKFVSMMVEKELKSMLEGLESLVDVGGGTGTMVKSICKAFPNLKCTVLDLAHVVSNMQGSHNLKFVSGDMFHSVPSGDVILLKHILHDWSDEECVKILKRCRDAISNKDKGGKVIIIEVVLDHKRGAHDLIEAQLCCDMLMMLAVSGKERNEKEWEKLFLDAGFTGYKITHALGLRSIIEVFP

SEQ ID NO: 1658 - protein, 346 aa, Nigella sativa
MEVENQNLSAQAKLWNYIYGYAETLVLKCAVQLDIANIIHNHGTPISLSDLASLLPNQPVNQDALYRVMRYLVHMELFTKSTSNGETNYSLGPSGKFLVKGWEKCMVDSILVITDDHYMSPWHYLGHGVSSKTSTAFEKVRGTNIWEYLADHPDKSQLFNAGMANDTRLVMSAVVKECKGIFGGVSTLVDVGGGTGTAVKYVAKAFPDIKCTVYDLPHVVADSSSDSGINFVEGDMFTSVPNADAIMMKCILHDWDDDKCVEILKRCKEAVPRDGGKVIIIDIVLDVDFKHPYAKMRLTLDLDMMTIGGKERSEEEWKKLIDGAGYKGCQITQISAVQSVIEAFPY

SEQ ID NO: 1659 - protein, 344 aa, Nigella sativa
VDKQNLASEARLWNYIYNYAESLVLKCAVQLDIANIIHNHGTPISLSDLASLLPNQPVNQDSLYRVMRYLVHMKVFTKSSSNGETYYSIGTCGRFLVKGWEKCMVDFILITTDEDFMNAWHYLGHALSSKTNTAFEKAQGTDIWGYLADRPEKNQLFNAAMANETRLVMPAVVKECRSIFDGVTTLVDVGGGTGTAVKYVAKAFPDIKCTAYDLPHVIADSSSDSGINFVEGDMFTCVPNADAIMLKGVLHDWDDDKCVEILRKCKEAVPREGGKVIIIDVVLDVDSKHPYAKIMLALDLEMMMMGGKERSEEEWKKLIYDAGYKSYEITQISAKPSLITAYPY

SEQ ID NO: 1660 - protein, 353 aa, Nigella sativa
MAEQEAMTEGQAQIWKIILAYADSMAIRCVVELGVPDIINTHGSPVSLQEIVACIKSSSPDVEYLNRIMRLCVRKGLFSTAAAPNEDGDTLYGLTPASKWLLSDNELSLAPMVLVATHERLMTPWRYFSQCVKEGGDSFTKAYGSAFYEYGSVQPEFNNLFNSAMAGTSKISGEALLASYKDGFEDVRTLVDVGGGTGTLIREIVKAHPHIKGINFDLPHVVATAPEATGVQNVSGDMLVEVPSADAYLLKTIFHSWNEESCIRILKNCRKAMEKSGGKLIIMDIMLRHQGSDLFDETRVAFDLVMMATSSGGKERTEVEWKSLLKVGGFSRYKVIECHALHSIIEAYPSELV

SEQ ID NO: 1661 - protein, 353 aa, Nigella sativa
MAEEEAAMVEGQAQIWKIILAYADSMAIRCAVELGIPDIINNHGGSASLSEIAAGINSPSPDVEYLNRIMRLCVRKGLFTTATTNGGGETLYGLTSASKWLLRDYELSLAPMVHVATHEWVVSPWRYFSQCVNEGGDAFTMAFGSNMFEYASVQPEFNKLFNSAMACTSKIAMEAMLESYKSGFEDVSSIVDIGGGTGTLIREIVKAHPHVKGINFDLPHVVATALEATGVQNVSGDMFVDVPPADAYLLKSILHDWNDENCIKILKNCRDAMGEKGGKVIIVDLVLKPQGSGLFDELRVVFDLVMMALTSGGKERTEVEWKNILEKAGFSHYKVIECNALPSIIEAYPTILN

SEQ ID NO: 1662 - protein, 354 aa, Nigella sativa
MAEEDRAMIEGQAQIWKIILAYADSMAIRCIVELGIPDIISTHGGPASLPEIAAAIISPSPDIEYLNRVMRLCVRKGLFTTTAAPNEAGETLYGLTHASKWLLRDNELSLAPMVHVATHEWVMSPWRFFSQCVKEGGDAFTMAYGSSMFEYASIQPEFNKLFNSAMACTSKLAVKALLESYKDGLQDVRSLVDIGGGTGTLIREIVKAHPHVQGINFDLPHVVATAPEATGVKNVSGDMFVDVPPADVYLLKSILHDWNDENCIKILKNCRKALSERGGKIIIVDFLLKPLGSDLFDETRVVHDLVMMALTSGGKERTEVEWKNLLEVGGFPRYKVIECHALPCIIEAFPNVLI

SEQ ID NO: 1663 - protein, 355 aa, Nigella sativa
MEEEEAAMIEGQAQIWKMILAYADTMAIKCVVELGIPDIINTYGGPASLLEIAASINSSSPDVDYLNRVMRLCVRKGLFTAAAAPTNEGGDGHDTLYGLTHASKWLLTDNELSLAPLVHLGTHDSTISSWRYLSQCVKEGGYAFSKAYGSEVFGFASLQPEFNKLYNSAMACSSKITSKALLESYENGFQDVRSLVDVGGGTGTLIREIVKAHPHVQGINFDLPHVVATTPEATGVQNVSGDMFVDVPPADAYILKSVLHDWTDEKCTKILENCHKAMGNRKGKIIIVEHILKPQKSGIFDEIGVVQDLVMMIGTPGGKERTEVEWKNLLETGGFPRYEVIESHDLHCIIVAFPT

SEQ ID NO: 1664 - protein, 359 aa, Nigella sativa
MVNTLDQGDSKHIQNEDIEAQALLWKHMYGFADTVMLRYTVTLGIPDIVHNHGTISLSQLAAQLPINDITIDRLNHFMRYLVHMKLFKISTDEISKEDKYELTPASKLLVKDHHKSLAAYVMLQTHPEEFSIWGRVIDYLEGKKGYWESTYGVRIDEKIGKDQEIYNHQLVNDAMTSNSRFMISALVGGLVQEKVLDGVRSIVDVGGNSGITAKAISDAFPDIKCSVMDLNHVIESVVKDPKLTYVAGDMFSSIPNADAVLLKSILHNYDDDECLKILKKATEAIPSKGSKVILVEIVTDLENQPELFSARLSMKMEMMLLGGKERTKQEWGTLLGKAGYSQHKIIPIMAIESIIVAYC

SEQ ID NO: 1665 - protein, 363 aa, Nigella sativa
MASTQNLLNLTPEQEEEACAYAMQLASASVLPMVLKAAIELDVLEIIAKAGHGVYSTPTQIASQLSSTANPHSHVMLDRMLRLLASYKVVSCNLRTLEDGSVERSYGLAPTSKFLVKNEDGVSMAPLVLMNQDKVLMESWYHLKDAVLDGGIPFNKAYGMTAFEYHGTDPRFNKVFNRGMADHSTITMKKILDIYKGFEGLKSLVDVGGGTGAIVNTIVTRHPTIKGINFDLPHVIEDAPAYPGVQHIGGDMFVSVPKGDAIFMKWILHDWSDEHCLKFLKNCYEALPQNGKVIIVESILPVFPETNLPAHGVFQLDNIMLAHNPGGKERTEKDFQALSSGAGFADFKVICCAFNSWVMEFCK

SEQ ID NO: 1666 - protein, 358 aa, Nigella sativa
MGSMEEAINEEENYLFAMHLVGASVLPMVMKVSIEMDLFEIIAKAGPGALLSPNTIASQLSIKNPNAVSMLDRALRLLASFSVLTSSVVRDENGVVERLYGLAPVCKYFVGNEDGVSLSPMLQLVQSKVFMDSWYHMKDAILEGGIPFNRAHGMHSFEYPGIDPEFNKIFNGAMFSHSSLFIKRVLEVYTGFDGLKEVIDVGGGVGTTINLITSKHPTIKGINFDLPHVIQHAPSYPGVEHVGGDMFDCVPSGEAIFMKWILHDWSDEDCVKLLKNCYKALPDHGKVILVEGILPVAVETNPGVQSLCEGDLIMMSQNTGGKERLEEEFENLAKGAGFARMTKACSFYNHWVIELYKK

SEQ ID NO: 1667 - protein, 364 aa, Nigella sativa
MPSSQIHERGSSSNEEEDYSFALQIATSAMMPMLMHAAVQLDVFGIIAKAGPGAKLSAKYIADQLPTQAPSTPFTLDRLLRFLASFSVLTSSLLTSEDGLSQRVYGLTSASKFFVPNEDGVSLAPLMMLVHDKAYTDMGMQLKEAIIDGGIPFTKAHGMHVFEYTKINSKFNQVFNNAMFNHTTIIVNKILETYKGFQEVEKVVDVGGGVGTAIGLITAKYPTIKGINFDLPHVIQHAHVCPGVEHVGGDMFEMVPTGGSIFLKWILHDWDDERCVVILKNCKKALSEDGKVIVVELVVPIEVESPDSTTRNAYQWDLAMWTISSGSKERSYEEFKLLANEAGFTRIEKVCSVYNFWVMEFYKK

SEQ ID NO: 1668 - protein, 360 aa, Nigella sativa
MGSIAETQMKKEDDGVYLFAMQLAVSSVLPMVMQQTIELKVFEIINKAGEGAHLSPTQIASELKTQNPEAPVMLDRMLRLLANHSVLSCSFVTKDDGHVERLYGLTPVCKYYIPDADGVSLAPLMIWTNDNDNVRCWPRLKDAVLDGGIAFEKVHGLGLFEYLGKNQKHNDLFNRAMYIHTSVIMKQIVEVYKGFDSLNVMVDVGGGIGTMSKIIASKYPAIKCINYDLPHVIESGLSHPGIEHVGGDMFASIPKADAVFMKCIIHDWDDERCLAILKNCYNALPENGKVIVVDIVLSTGAETENGAKGTAEIDVFMMMQCPGGKERTVKDFEDLAKGAGFGTINVVCSLSNYWLMEFHK

SEQ ID NO: 1669 - protein, 355 aa, Papaver bracteatum
MGSLAKPAETQEVSIKDQAQLWNIIYGFADSLVLRCAVEIGIADIIKNNDGAITLAQLASKLPVPNVSSDYLYRMVRYLVHLNILAQETCNGGVEKVYSLKPVGTLLLRDAERSMVPMILGMTEKDFMVSWHFINSGLGAGGGVVFAGGMGMDIWKYLESNPDQSQLFNEGMAGETRLLTKTLIEDCRDTFQGLDSLVDIGGGNGTTIKAIHEAFPHIKCSLYDLPHVVANSHDLPNIEKVPGDMFKSVPSAQAILLKLILHDWTDEECVNILKKCKEAIPKETGKVIIVDVALEEESNHELTKTRLILDIDMLVNTGGRERTADDWENLLKRAGFRSHRIRPIRAIQSVIEAFP

SEQ ID NO: 1670 - protein, 357 aa, Papaver bracteatum
MDTLYANPAETQEEIGIKDQAQIWNLIYGFADSLVLRCTVEIGLPDIIKNNNGPITLAQLSSKLPIPDVNSDHLHRILRYLVHLNILRQETCNGGADKVYSLKPAGTLLLSDAEGSMIPILLGMTEKDFMLPWHFMKEGLGNGSTTAFEKGVGMDVWEYLEANPDQSRLFDEGMAATTRLLSKTLVEDCRGTFEGLDSLVDVGGGNGTTIMAISEAFPHIKCTLFDLPRVIASSHNHPNIERVPGDMFKSVPIAQAILLKMVLHDWDDEACVKILKKCKEAIPKETGKVIIVDAALEEESEHELTKTRLILDIDMLVNSGGRERTADDWEILLKRAGFRSHRIRPIRAIQSVIEAFP

SEQ ID NO: 1671 - protein, 353 aa, Papaver bracteatum
MGSQATETQVVSLEDQAQIWNIIYGFADSLVLRCAVQIGIPDIIKNNKGSITLAQLSSKLPIPDVNSGHLQRIIRYLVQLDILQQETCNGGAEMVYSLKPAGTLLLRDAKISMVPMLLGLTQKDFMVPWHFIKEVLGNGSATAFEIGMGKTMWQYLADNPEQSQLFDEGMAGDITLLSKTLTEDCSDIFQGLDSLVDVGGGNGAAIMAIYEAFPHIKCTLFDLPHVIASSHNHPKIEKIPGDMFKSVPSAQALLLKSILHDWTDEECVKILKNCKEAIPKETGKVIIVDIALEEESTHPLAKKRLVLDIDMLVNTGGRERTADDWENLLKSAGFRSHKISPIRAMQSVIEAFP

SEQ ID NO: 1672 - protein, 346 aa, Papaver bracteatum
METVSKIDQQNQAKIWKQIYGFAESLVLKCAVQLEIAETLHNNVKPMSLSELASKLPVAQPVNEDRLFRIMRYLVHMELFKIDATTQKYSLAPPAKYLLRGWEKSMVDSILCINDKDFLAPWHHLGDGLTGNCDAFEKALGKSIWVYMSENPEKNQLFNAAMACDTRLVTSALANECKSIFSDGIRTLVDVGGGTGTAVKTISKAFPDIKCTIYDLPHVIADSPEIPNITKISGDMFKSIPSADAIFMKCILHDWNDEECIQILKRCKEALPKDGKVIIVDVVIDMDSTHPYAKIRLTLDLDMMLNTGGKERTKEEWKILFDAAGFASHKVTQISAVQSVIEAYPY

SEQ ID NO: 1673 - protein, 349 aa, Papaver bracteatum
MEVVYKIDQENQAKIWKMIYGFSESLVLKCAVQLEIAETIHNHGKPMSLSELASKLPVQPVNSDRLFRIMRYLVHMKLFKIEVSSLNGGSAYSLAPPGKYLIRGWGKSMVASILAMNDNDLLAPWHHLNEGLTGNCNAFEKALGKSIWVYMSENPEKNQLFNEAMACDTELVNSALVNECKSVFCNGTKTLVDVGGGIGAAMMAISEAFPSIKCTIFDLPHVIAESPEMPNITKISGDMFESIPSADAIFMKNILHDWNDDKCIQILKRCKEALPRGGKVIIVDIVLDVADSVNPFSKIRLASDLDMMLNTGGRERTEKELKKLIDASGFASYKITQMSAVQSVIEVYP

SEQ ID NO: 1674 - protein, 363 aa, Papaver bracteatum
LNSTSKEEIELIQAHTHIWKYVFSYANSMSLKCVVELGIPDIIHSHGKPMTLSSLVDALFLPSARIDPLNRLMRFMIHSGFFETRSLGENQEQQGYILTPTSRLLVKANPKTMSSVVLSMVDPIMVSSFQSLHTWFQGSESSPFVAAHGMSLWNLLEQNPESGKNFHDSMANDSCVLMSVILNEGKGVFNNLKSLVDVGGGTGTTAHAVVGAFPHLNCMVLDLPNVVADLQGTANVVFIGGDMFESIPHADAVLLKFILHDWSDKDCVRILKMCREAIPSTEEGGKVIIIDAVIEEDKKKKQEAKDDSIITETQLLFDIMMMAFVNGKERTEKEWKKLFIDSGFTDYKITRVQGFRSFIEVYP

SEQ ID NO: 1675 - protein, 353 aa, Papaver bracteatum
MDAEEEITKGQAEIWEHMFAFADSMALKCAVELGIPDIINSHGHPVTVFEIINSLKTTTSSSSPNIDYLTRVMRLLVRKSIFTSHFHQETNQILYGLTPSSKWLLRDSKFNLSPTISFFLHPSILKPWQYLGNCTKENGLAFQKAHGCEIWDMAAADPHFNQVFNDGMGCTAKMIVSQMLTEYKDGFNCIGSLVDVGGGKGAMIAAIVEANPHITGINFDLPHVLATAQEHPGVTHVTGDMFVEIPEADAVIMKWIMHDWSDENCVKILKNCYKAISKTKNGKVIIVDCVLQPEGNGLFDETGVAFDLLMMVIPGGKERTEVEWNNLLKSAGFPRYNLIQIPTIHSIIEAFPE

SEQ ID NO: 1676 - protein, 352 aa, Papaver bracteatum
MDTAEERLKGQAEIWEHMFAFVDSMALKCAVELGIPDIINSHGRPITMSEIIDYLKTNTSSLNVDYLTRVMRLLVHKRLFTSQLHQENNQIVYGLTRSSKWLLKDSKFNLSPLVLFETSPQPLKPWQYLGKCVQENGLPFESAHGCGIWDLALADPKFNGKLNGAMQCMTILIINEMLTEYKGGFNGIRSIVDVGGGTGTLLAEIVGANPHIQGINFDLPHVVTTCPDILGVKHLGGDMFVSIPEADAVIMKSLLHDWTDEDCTKILKNCYKAITNKKNGKVIIVEFVLRPEGNGLFDKTGLILDMVMLAHTSGGKERTEVEWKMLLSNAGFPRYNILQTPACPCIIEAFPE

SEQ ID NO: 1677 - protein, 355 aa, Papaver bracteatum
MDIEEERLKGQAEIWEHMFAFANSMALKCAIELGMPDIINSYGRPVTMSEIINSLKKTTLSSSPNVDYLTRVMRLLVHKRIFASQFHQESNQILYDLTPSSKWLLRDSKSTLAPMILLHLHPLFLKPWQYVGKSVEESGFPFEKAHGCDAWDLALANPHFNQLFNDGMECSAKIAVNKMLANYKGGFNGIGVLVDVGGGTGSMIAGIVKANPHIRGVNFDLPHVVATAPEHPGITHVGGDMFADIPEGDAIIMKWIMHDWSDEDCIKILRNCYKAISKTKNGKVIIVDCVLQPDHGNGLFDEAGLLFDLLMMVNTSGGKERTEVEWNMLLNSAGFTRYNIIQIPTFPSIIEAFPE

SEQ ID NO: 1678 - protein, 354 aa, Papaver bracteatum
MDTAEERLKGQAEIWEHMFAFVDSMALKCAVELGIPDIINSHGHPVTISEIIDSLKKSTSTSPNIDYLTRIMRLLVHKKLFTSQFHQESNQIVYDLTRSSKWLLKDSKFNLSPLVLWENNPILLKPWQYLGKCVQENSSPFERAHGCEIWDLALADPKFNNFLNGAMRCSTTTIINEMLLEYKDGFSGIAGSLVDVGGGTGSIIAEIVEANPHIQGINFDLPHVVATAPEFPGVKHVGGDMFVDIPEADAVIMKWTLHDWSDEDCTIILKNCYQAIRKKKNGKVIIVDCVLRPDGNDLFDKMGLIFDVLMMAHTTAGKERTEAEWKILLNNAGFPRYNVIRTPAFSCIIEAFPE

SEQ ID NO: 1679 - protein, 353 aa, Papaver bracteatum
MDTAEERLKGQIEIWELTGAVIDSMALRCAVELGIPDIINSHGRPITISEIINSLKSTKASPNAEYLTRVMRLLVHNRVFTSQVHQESNQIVYNLTRSSKWLLKDSKFNLSPTVLFDTHPIIVKPWQYLGRCVQENGFPFERAHGREIWDLASADPKFNNLLNGAMGCTSTTIINEMLLGYKDGFSGIGSLVDVGGGTGTIIAEIVEANPHIIGTNFDLPHVVATAPDFPGIKHVGGDMFVNIPEADAVLMKWILHDWSDEDCTKILKNCYKAITKKKNGKVIIVECVLRPGGTGLFDKIGLIFDMGMLALTSGGKERTEDEWKMLLNNAGFPRYNIIQTPSCAYCIIVAFPE

SEQ ID NO: 1680 - protein, 353 aa, Papaver bracteatum
MDAEEERLKGQAEILEHMFAFVDSMALKCVVELGIPDIINSHSRPVTMSEIIDNLKTNNLSSPNVDYLTRVMRFLVHKGLFSSQFHQESNQDVYNLTRSSKWLLKDSKFDLSPFVIVETNPILQKPWQYLGKCVQENGLPFERAYGCGIWDLALIDPKFNNNFNCAMQCMTMMMINEMLIEHKDRFNGIGLLVDVGGGTGTMIAEIVKANPHMQGMNFDLPHVVATAPDFPGVKHVGGDMFIDIPEADAVIMKLVLHDWTDEDCRKILKNCYNAITNKKDGKVIIVEYVLRPEESGLFDKTGLILDMVMMVHTSGGKERNEVEWKVLLNNAGFPRCNIFQSPAYICFIEAFPE

SEQ ID NO: 1681 - protein, 339 aa, Papaver bracteatum
MEVVNKIDQENQAKIWKQIYGFAESLVLKCAVQLQIAETLHNNVKPMSLSDLASKLPVQPVNEDRLYRILRYLVHMKLFNKNATTQRYSLAPPAKYLLRGWEKSMVASILSVTDKDFTAPWKHLSDGLTGNCNAFEKALGKSIRVYMSENPEKNQLFNEGMACDTGLFTSAMVNECKNILSDGINTLALVGGGAGTAVKAISKAFPETKCTIHDLPQILSNINKTSRDLFKSVPSADAIFMKSILHEWNDEECIQILKRCKEAVPNGGKVIIADVVLDMDSTHPYSKSRLAMDLDMMLHTGGKERTEEDWKKLIDAAGFASCKITNLSALQSVIEAYPH

SEQ ID NO: 1682 - protein, 354 aa, Papaver bracteatum
MEIKLEDQEQEMKNQGHVWNIICGSVDSSVLKCTVELGILDTIHHSSKPMTLSSLSSASPSLSTLKAENLYRLLRYLSHMNLIAIDSTEGNETFSLTGLSKLLLKNQERSLKDWVLGIDDEHSINGWHELSDYCLSATDAPTPFVKLYGKTLWEFAAEVPEVNELINNAMACDTRMVMPAFVQGCDSILKSVKKLVDIGGGTGAAMSYVVKAYPEIKCMAFDLPHVVAAAPEVPGVEMVGGDMFDIIPSADALLLKFMLHNWKDAECIKLLKRCKETIPEDNGKVIIIEMVLDQDEDDDVLTQARLSLDLDMMLSSGGKERTKDEWRILLEEAGFNKIEFIPIFAIQSVIVAYP

SEQ ID NO: 1683 - protein, 373 aa, Papaver bracteatum
MATLSSKITGPERVLDEGIHFESQEQEMKYQAQIWNHMCGVVDTSVLKCAIELGIFDAIHNSSKPAITLTELSSVISSSTPSASSIEPRNLYRLMRYLSQMNLISTEKCSDEVTVSLTDTSKLLLRNQEKSLIDWVLGISSEPCVLVWHELSSSLSTPADGPPSFEKVHGKNCYELAGENPEWNELINNGMTSDTSLTMPAFIQGCDRILKGITSLIDVGGGTGASMAYVVKAFPHIKCGVFDLPHVVEAAPQCPGVEFIGGDVFKFLPNADALLLKYTLHNWEDPECVDLLKRCKEVIPADNGKVIIMDLVIDQDDNDTLMQARLSLDLDVLNHGGRERTKEDWRNLIEMSGFSRHEIIPIFAMPSVIVAYP

SEQ ID NO: 1684 - protein, 358 aa, Papaver bracteatum
MDIKLEDEEQEIKYQGHVWNMICGSVNSSVLKCTIVLGLFDTIHNSSKPMTLSSLSSASPSLSPLKTEKLYRLLRYLSHMNLIAINSVQGSDDTFSLTDTSKLLLSNQERSLKDWVLGIDDPLAINGWHELSDYCLSPVDAPVPFVKMHGKTMWEFAAEIPEVNELFNNSMACDTKLVMPAFLQGCHSIFNKGTVKKMVDIGGGTGAAMSYVVKAFPDIKCMVFDLPHVVANAPEIQGVELVGGDMFEFIPPADALLLKFILHNWDDVGCIKLLKKCKETISADHGKVIIIEMVLEEDDHDNDALTQARLSLDLDMMVCSGGRERTKDEWTTLVEQAGFSKIEFFPIFAIQSVIVAYP

SEQ ID NO: 1685 - protein, 357 aa, Papaver bracteatum
MEIQMEDEQLEMKYQSQIWNHVCGSVNTSVLKCSISLGIFDVIHDSGKSMLTLTELSNSLSSSNMIKTHNLYRLLRYLSHMNLIAISSIQGNDHFSLTDLSKLLLGNQEKSLKDWAIGIGDVNFVATWHEMSSSCSKLPGDLTAWETVHGKEGYELNVEDPEFSERFDKAMSSDTTLAMPAFIQGCDIIMSGISSLVDVGGGIGTAMTYVVKAFPHIKCTVFDVPHVIHTAADPAKCHGIEFIGGDLFSFIPPADAILLKFMLHNWEDEECKNILKRCKEAIPADKGKVIIMDIVLDENADNDDLVQAKLSMDLDMMSSGGRERTKEDWKNLLEMSGFTSHEIIPILAIQSIIVAYP

SEQ ID NO: 1686 - protein, 338 aa, Papaver bracteatum
MMSIRFRLLRYLSHMNLIAMNAIEGNETFSLTGISKLLLKNQERSLKDWVLGIDDEHSINGWHELSDYCLSATDAPTPFVKLYGKTLWEFAAEVPEVNELINNAMACDTRMVMPAFVQGCDSILKSVKKLVDIGGGTGAAMSYVVKAYPEIKCMAFDLPHVVAAAPEVPGVEMVGGDMFEFIPPADALLLKFMLHNWKDAECISMAFDLPHVVAAAPEIPGVEMVGGDMFDFIPSADALLLKFMLHNWKDAECIKLLKRCKETIPEDNGKVIIIEMVLDQDEDDDDLTQARLSLDLDMMLSSGGKERTKDEWRILLEEAGFNKIEFIPIFAIQSVIVA

SEQ ID NO: 1687 - protein, 390 aa, Papaver bracteatum
MATNGEIFDTYGHNHQTATVTKITASDDSSNDVCYLSETANLGKLICIPMALRAAMELNVFQLISKFGTDAKVSASEIASKMPNTTSNPTAAIYLDRVLRLLGASSILSVSTRKKLINGGGEDRVVHEKVYGLTNSSCCLVPREEDGVSLVEELLFTSDKVVVDSFFKLKCVVEEKDSVPFEVAHGAKIFEYAATEPRMNKVFNDGMAVFSIVVFEAVFRVYDGFLDMKELLDVGGGIGTSVSKIVAKYPFIRGVNFDLPHVISVAPQYPGVEHVAGDMFEEVPKGQNMLLKWVLHDWGDERCVKLLKNCWKSLPAGGKVLIIEFVLPNELGNNAESFNALIPDLLLMALNPGGKERTISEYDDLAKAAGFIKTIPIPISNGLHVIEFHK

SEQ ID NO: 1688 - protein, 388 aa, Papaver bracteatum
MTMEIDHGEEHDTSASSTTNLGDDVSYLSDNANLGKLICIPMALRAAMELNVFQLISKFGLDAKVSASQLVSKMPNAPNNPNAAMYLDRILRLLGASSILSVSNSMESGGHCVNQNNGEAGAVAMERVYGLTRASYCLVPREEDGVSLVPLLVLQSDKVIVDSFFKLKEMVMEKDVVPFDAAHGISIFEYACKEPRLNKAFNEGMGAFSAVVFEAVFKYYDGFSGMKELLDVGGGIGTSVSKIVAKYHSIRGINFDLPHVISVAPQYPGVEHVQGDMFEQVPKAQNMLLKWILHDYDDEHCVKLLKNCWNSLQVGGRVMIIEFAVPNKLVNSAETFNPLNSDLMMMAVNPGGKERTMFEFNNLASASGFAKTVHFLISESLHLIEFHK

SEQ ID NO: 1689 - protein, 373 aa, Papaver bracteatum
MSYSIPIHVNELNHQDLEENDDQLCILACQIAACSGLPMALKAALDLDLLETIAKAGPNAYISPLEISSKLGTQNPNAPSMLDRLLRLLTSFSILKCSQITTQDGKIQRLYGLAPVCKYFTRDPENGVSVAPLAVMNTDRVFIDSWYHFKDAVMEGGIPFNRAHGMSAFEYPGLDLRFNQVFNKAMSDHTTLTMTKVLEKYKGFEGIKVLVDVGGGVGVTTKMITAKYPQLKGINFDLPHVLADATTYPGVENVGGDMFVSVPRGDAIFMKWILHDWSDEYCLKLLKNCYEALPDCGKVIIIEANLPAVIDDSVTSKLLFEQDMVMLTQNPGGKERTFSEFEDLAKQSGFASCETLCSVYYSYVMEFHKTARI

SEQ ID NO: 1690 - protein, 375 aa, Papaver bracteatum
MGSGHHSKHKGDHHEEEHSKDKKEEQACMFALQLASASVPVMVLRAAIEMDVLEIMNRAGPGSELSAAYIASQILNVTNPNASIMLDRMLRLLASYKILTCSDRTLDDGTTERVYGLELVCKFLVKDDDGVSMAPLLLMNQDKILLESWFHLKDAVVTGGIPFNLAYGMNAFEYPATDARFNTVFNKGMSDHTAIFMKKILETYKGFEGINSIVDVGGGVGVSLDMILTKYPSMKGINFDLPHVIKDAPAYESAVEHVGGDMFVSVPKGTDAVFMKWILHDWSDEFCTKVLKNIHDALPEHGKLILVECIIPPTCEPTLEALGVYHVDNMMMAYNPGGKERTEKEFDALAKATGFSGVKLICSAFNTWIMECHKN

SEQ ID NO: 1691 - protein, 352 aa, Sanguinaria canadensis
MGINDKPESQEVDIKAQAHLWSIIYGFADSLVLRCAVEIGIADIIKNNNGSISVTELSSKLPISNVNSDNLYRVLRYLVHMGILKEDSDNNGVKLYSLQPVATLLLRDAERSMVPIILGMTQKDFMVPWHFMKEGLGNGGTAFEKGMGMTIWQYLEGHPEQSQLFNEGMAGETRLLTKSLIEGCKDTFEGLTSLVDVGGGNGTTIKAIYDAFPHIKCSVYDLPHVIASSHDLPNIERIPGDMFKSIPSAQAILLKLILHDWTDEECVNILKKCKEAVPKETGKVIIVDVALEEESQHELTKTRLILDIDMLVNTGGRERTEDDWEKLLKRAGFRGHKIRHIAAIQSVIEAFP

SEQ ID NO: 1692 - protein, 348 aa, Sanguinaria canadensis
MEANKSDQATQAKIWKLIYGFAESLVLKCAVQLEIADTIHNHGKPMTLSELASELPIQPVNSDRLYRVMRYLVHMKLFNKEKSTINGEFKYSLAPPAKFLIKGWEKSMVASILAINDKDFLAPWHHLKDGLVGDCDVFEKALGKSIWVYMSENPEKNQLFNEAMACDTRLVTSALVNNCGNVFHGIKTLVDVGGGTGTAVKAISKAFPHIKCTIYDLPHVIADSPEIPNIVKIEGDMFKSVPSADAILMKCILHDWNDEECIQILKKCKEAVPREGGKVIIVDVVLNMDSTHPYSKIRFTLDLDMMLNTGGKERTLEEWKKLIDAAGFASFKITQMSTVQSVIEAYPY

SEQ ID NO: 1693 - protein, 349 aa, Sanguinaria canadensis
MQQAQAQVYNHLFSFVSSMSLKCAVQLGIPDLIHNHGQPITLSSLVEALSLPPTKTDSVYRLMRVLVHLGVFARQKIDENQQEEGYVLTPSTRLLLEDNTKMSLSLVVDMLGPVLVKPWELLRAWFQGSGSTAFEAANGMTFWKYLEQNSEFNKAFNNTMGFDSRLVMSAIVNDCKAVFENLSSLVDVGGGMGGAAQVISDAFPHLKCLVLDLPNLVADLPAERSTKNLDYIGGNMFDSIPHADAVLLKSVLHDWSDNDCVKILKRCREAIPSREEGGKLIIIEIVMEDRKQGHETTEIQLSLDMLMMILLDGKERSEKEWEKLFSESGFTDHKITPIPGFRSLIEVYP

SEQ ID NO: 1694 - protein, 354 aa, Sanguinaria canadensis
MEIQLGDQEQEMKWQGQVWNHICGSVDSSVLKCSIELGIFDTIHSSGKPMITLSELATSPSLVSIKTQNLYRLLRYLAHMNLITINIVEGNETFSLTDLSKLLLRDKEKSLVDWALGIDDETCVTVWHELSSSCSLPADAPTSFEKVHGKSIWELAEENPKLNQFINNAMASDTRLVMPAFIQGCAKVLNEITSLVDIGGGTGTAMSYVVKAFPEIKCTVFDLPHVVASSPQSPCVDMIGGDMFEFIPPADSVLLKFMLHNWEDGECIKLLKRCKEAIPTDQGKVIIIEMVLDQDEDDYDLTQARLSLDLDMMLSSGGKERTKDEWRVLLEMAGFSKIEFIPIFAIQSVIVAYP

SEQ ID NO: 1695 - protein, 354 aa, Sanguinaria canadensis
MEIQLGDQEQEMKWQGQVWNHICGSVDSAVLKCTIELGLLDTIHSSSPKPITLSELSTSPSLSSLKTQNLYRLLRYLSHMNLITINFHEGNETFSLTDISKLLLQNQERSLKDWVLGIDDEHSINSWHELSSYCASPADAPTPFVKLHGKTLWELAEEVPEVNELINNGMACDTRMVMPAFIQGCDKILSGITKLVDVGGGTGAAMSYVVKAFPQIKGTVFDLPHVVATAPQIPGVEMVGGDMFEGIPPADALLLKFMLHNWIDDECIKLLKRCKEAIPTDQGKVIIIEMVLDQDEDDYDLTQARLSLDLDMMLSSGGKERTKDEWRVLLEMAGFSKIEFIPIFAIQSVIVAYP

SEQ ID NO: 1696 - protein, 369 aa, Sanguinaria canadensis
MGSTQNQFNATTEEDEEAQACMYAMQLASATVPVMVLKTAVELDLLEIIKKAGPPGTQISSTEIASQIPNNKNPESPVMLDRMMRLLASYKILTCSLRNLDQDGKVERLYGLAPVCKFLTKNEVGCSMAPLLLMNQDKVLMESWHYLKEAVLDGGIPFNKAYGMTAFEYHGTDPRFNKVFNKGMSDHTTITMNKILETYKGFEGLTSIVDVGGGIGATVNMIVSKYPTIKGINFDLPHVIGDAPSYPGVEHVGGDMFASIPKGDAIFMKWILHDWSDEHSIKILKNCYEALPENGKVILVECIIPVLPEPNNSAGHGVFHLDNIMLAHNPGGKERTEKEFEALAKGTGFSGFKVVCSAFDTYVMELSKN

SEQ ID NO: 1697 - protein, 346 aa, Sanguinaria canadensis
MQLASASVPVMVLKAAVELDVLEIIAKAGPGAQISASDIVSQIPNVKNPNAPVMLDRMLRLLASYKILTCSVRDLEEDDGLVKERLYGLALVCKFLVKNEDGCSMAPLLLMNQDKVFLESWFHLKDAVIDGGIPFNKAYGMNAFEYQGSDPRFNKIFNRGMSDHTTITMKKILETYKGFEGLTSLVDVGGGIGVTVDAIVSKYPTIKGINFDLPHVIEDAPSYPGVEHVGGDMFVSVPKGADAIFMKWILHDWSDEHSIQILKNCYEALPDHGKVIIVECIIPPYPETSLSGLGVFHVDNIMLAHNPGGKERTEKEFEALAKGTGFAGFRVICSAFNTWVMEFSKN

SEQ ID NO: 1698 - protein, 386 aa, Sanguinaria canadensis
MDANEATNSCYISEAGNLGRLICLPMALRAAIELNVFNIISGFGPEAQVSSRDLVAKIPTTNPNAHIFLERILRMLAASSFLSVSTRPLSASSPTPVNGHNGNSINGHEYNHDHNHDKVKVVQERVYGLTKEARCLVPREEDGVSLVPMLMFLADKVVVESFYNLKEVVLQQGRVPFDMTHGVSIFEYAGKEPRMNKVFNEAMGDFSVVAFDEVLKVYSGFLDMKELVDVGGGIGTSLSNIVAKFPLIRGINFDLAHVISVAPNYPGIEHVAGDMFKELPKAQNILLKWVLHDWDDEQGLKLLKNCWNSLREGGKVIVIEFVIPSEIGDNAESFNALTPDLLMMALNPGGKERTIVEFYDLANAAGFAKAKAFPIAKGLHVIEFHK

SEQ ID NO: 1699 - protein, 397 aa, Sanguinaria canadensis
MNSSSSTIKSSNININERESDSEEELCLLALQIASCSVLPMALKTALDLDLFEVMAKAGPNAYLSPLEISSQLGGTDQNPDAPAMLGRILRLLTTFSILKCSSTRTIKLLLNKNEQQAHDQNGQVDHDDQTTRLFYGLGPVCKYFTRNEDGVSLAPLALLHQDKLLMDSWYHLKDVFIEGGIPFNRAHGMSVFEYPGIDLRFNKLLNNAMSGHTTLTMKKVLETYKGFEDLKELVDVGGGVGITTNLITSKYPQIKGTNFDLPHVLADAPSYPGVEHVEGDMFESVPRGEAIFMKWILHDWSDEHCLKLLKNCYEALPNSGKVIIVEYIVPMVIDTSVNSKFIFQLDLLLLSQTNGGKERTFKEFEALAKQSGFARCETICTGYHSSIMEFHKTAKN

SEQ ID NO: 1700 - protein, 352 aa, Sanguinaria canadensis
MGVNDMAVSQEVDIKAQAHLWNIIYGFADSLVLRCAVEIGIADIIKNNNGSISVSELSSKLPISNVNSDNLYRVLRYLVHMGILKEDSDINGVKLFSLQPVATLLLRDAERSMVPIILGMTQKDFMVPWHFMKEGLGDGSTAFEKGMGMTIWQYLEGHPEQSQLFNEGMAGETRLLTKSLIEGCRDTFEGLTSLVDVGGGNGTTIKGIYDAFPQIKCSVYDLPHVIASSPEHPNIERIPGDMFKSVPSAQAILLKLILHDWTDEECVNILTKCREAVPKETGRVIIVDVALEEESQHELTKTRLILDIDMLVNTGGRERTEDDWEKLIKRAGFRGHKIRHIAAIQSVIEAFP

SEQ ID NO: 1701 - protein, 358 aa, Stylophorum diphyllum
MALQSDEQVLHSQTHIWNHIFSFINSMSLKCAIQLEIPDIIERHGAPMLLSELVDALSINKERAPFVYRLMRLLVHSGFFVKQKVSEESEEGYLLAPASRFLLKEEPLSIRPFLLAMLDPIVMDPWQHLSKWFQNNDINPFYTAHGKNPWELLRHKPELIQLTNEGWASDSRLVTSVILKQSGTGSAFFEGLNSIVDVGGGTGTVAKAIADAFPKLSCISFDLPQVVNGLVGGKNLSFIGGDMFQEIPKADAVLLKWILHGWNDEECLKILKRCKEAIPSKENGGKVIIIDMVVKDHQGPGDDEFIKAQLFFDMLMMASQTGRERNEKDWAKLFLDAGFSDYKITHNLGSRSFIEVYP

SEQ ID NO: 1702 - protein, 359 aa, Stylophorum diphyllum
MGSIADQEVKDNEMMQVNSDVWKYTFSFIRSMSLKCAIELGIPEIIHNHGKPMTLSGLVDNLAVPPTKADSLNRLMRFLIHGGFFAKEKLDENQEEEGFVLTQSSRFLVKDNKNTLSSIVLAMVDPVMATPLHFLSTLFRGNESSAFEAAHGMRLWNYLEQHPEFGKTVYDAMANDSRLSMSVIVNEGKAVFENLKSLVDVGGCTGVATQTISEAFPHLKCTVLDLPHVVAGLPNSKNLDFVGGDMFESIPRSDAVLLKFVLHDWNDNDCVRILKNCKEAIPSREEGGKVIIIDAVVEDMKQEHERTETQLLLDIWMMVQLGGKERTEKEWEKLFIESGFIDYKITPFVGFRSVIEVYP

SEQ ID NO: 1703 - protein, 290 aa, Stylophorum diphyllum
MTKMKERLEEDARLQGQADIWDLMFAFADSMVLKCAIELGIADIINSHGRPITLTEIIDAIRSNSSVPSTPNHNYLSRVMTFLVRKRVFSAQTHPENGETLYNLTASSKWLVKDSEFTLASMVLAQLHPWLMSPWHYFTKCVQEGGIAFEKAHGSEIWDFALAHPDFNELFNGGMACASKIIVNSILVTYKEGLNGLGSIVDVGGGTGMVIGEVVKAHPHVRGINFDLTHVVASAPEYEGVRHVAGDMFVDIPHADAVIMKVDGCLVPTFFQVSKSMPCILSDYKLSSQS

SEQ ID NO: 1704 - protein, 359 aa, Stylophorum diphyllum
MGSIEAAITNQSNEENFTYAMQLVTSTSLTMVLVNTIKLKAFEVMAEAGSDARLSAHEIVSRLAITNQDAPEMLDRMLRLLASHSIVTCTQGDYKSRPVRLYGLTPVAKYFIPNEDGASLGALMQLLQDKVFIDSWFELKDSVVGGGIPFNKVHGTHAFEYPALDARFNEVFNNAMVNHTTIAMKTILECYHGFGNLKSVVDVGGGLGITINMIVSKHPTIKGINFDLPHVIRHAPLYPGIEHVGGDMFQEVPQGDAIFMKWILHDWSDDHCTKLLQNCYKALPENGKVIIVEAVLPFVPETSSSVKVSTQIDAIMMTQNPGGKERTEEEFLALAKSGGFKGIKKECFACNFWVMEFYK

SEQ ID NO: 1705 - protein, 404 aa, Stylophorum diphyllum
MEAKEEGRMNGCYISEAGHLGRLICLPLALRAAIELNVFNLISEFGPKAQVSSRDLVAKIPTTNTDAHIYLERILRMLAASSFLSVSTRTTSLTASNTNGHHNSNTNGGHAHQHDEKTFSTNGHHNGSIDGGDHQHDGKETERVYGLTMESSCLVPCDDDGVSLVSMFMFLSDKVVVESFYNLKEVVLQHGRVPFDMTHGVSIFEYAGKEPRMNKVFNEAMGDFSVVAFDEALKVYNGFLEMKELVDVGGGIGISLSNIVAKYPLIRGINFDLPHVISVAPNYPGVEHVAGDMFKELPKAQNILLKWVLHDWDDEPCLKLLKSCWNALPEGGKVIVIEFVVPTKIGDNAESFNALTPDLIMMALNPGGKERTLIEFYDLANATGFAEVKSYPISQGLHVLEFHK

SEQ ID NO: 1706 - protein, 354 aa, Stylophorum diphyllum
MGSSVLDAKQDEEAFLFAMQLASASVLPMVLKSAIELDLLEIIAKAGPGAYVSPADLAAQLPKLENPEAPVMLDRICRLLASYSVLTCKLDEGVRLYGLAPVCKYLVKNEDGVSNAALLLMNQDKILMESWYHLKDAVLDGGIPFNKAYGMTAFEYHGKDDRFNKVFNSGMYNHSTMTMKKILDIYEGFDNLTTLVDVGGGTGASLNMIVSKHPSVKGINFDLPHVIQDAATLPGIEHVGGDMFESVPKGDAIFMKWICHDWSDAHCLKFLKNCYAALPDHGKVIVAECILPETPDSTLATQNVVHIDVIMLAHNPGGKERTEKEFEALAKGAGFTGFRKACCALNTWVMEFTK

SEQ ID NO: 1707 - protein, 351 aa, Tinospora cordifolia
MEAATLKQDQQAQAKIWKFIYGFSESLVLKCAIDLEIPDIIHNHGTPISLSQLSSQIAPAKQPVDSDRLYRIMRYLVHMGLFTEESISGELRYGLAPPAKYLVKGWEKSVVPSLLCINDKDMMSPWHYLKDSTVAGDNRTAFEMALGVNIWDYMGKNPKKNSVFNEAMACDTRLLMSAMVNECKDMFQGIKSLVDVGGGTGTAVRNIAKAFPHIKCTVFDLPHVAADSPVYPEVNRIEGDMFKGIPSADAILMKCILHDWDDKECIEILKKCKEAVPEDGGKVIVVDIVLNAHSDHPYTKMRMVMDLDMMLNCGGKERTEEEWKKLIYAAGFSRYNIRQINAIQSVIEIYP

SEQ ID NO: 1708 - protein, 341 aa, Tinospora cordifolia >
MEEERNAQALVWRYAYGFADSLTLKCAIQLGIADILHQHGQPMTLSELASSLPLPTVNQDRLHRIMRYLVHMGLFDLVDSDTKYALNPASTLLVRTQPKNLASFALLQYYEMDAWHHLSAAVEGHVTPWEKCHGTDYREYFAKDEVANQLLSDAMTSHTSMVTEALVEGCKKGKVLDGVRSFVDVGGSTGVAARAVAKAFPWVKCAVFDLPHVIATAPECPGVERIAGDMFASVPETDVVFMKSVLHDWGDEDCVKILKKCKEAIGGKKEGKVVILDIVLDAKSSNEFEGARLGMDMDMLVTVGGKERSEEEWKKLFKDSGYSHYKITPIVAIESIIELFP

SEQ ID NO: 1709 - protein, 354 aa, Tinospora cordifolia
EEEEEEDIKAQAQLWKQIYGFTETFMLRCAVQLGIPDIIHEKGPMTLTDLASELQIVSNAINMERFGHTMRFLVHMKLFTLSGENKYQLTPASKLLLKDPKQKKSLASYVILQTNPEEFSFWGSYVDNLSSGSCSTKSYWESKYGVNGLYEFIEKEADQNKLMNDGMMSHTKCMVQALVNGLKKEKVLEGVNSLVEVGGNSGDVAKAIIDVFPYLKCTVMDLVHVIEAVPKDCPLIDFVAGDMFDLVPRADAVLLKSTLHNHADDACIKILNKCKEAIDPTRGRLILVEIVVDTQHLQSEFASARLSMDMDMILFFGGKERTKQEWEDLLEKVGFSHHKIYPIMAMESIIVAYP

SEQ ID NO: 1710 - protein, 349 aa, Tinospora cordifolia
MKWQAQVWNHTAGGFADSIVLKCAIDLAIFDTIHSHICKQGKQMITISELVSSPNLSSINTHKLYRLLRYLAHMKLLAVQVIDGGEEAFSLTELSKFLVRDNEKNLVDWAVGILDMPAMKAWHQLSSCMSYPSSGPTPFEKEHGKSVWEFARDNPEMNEVLNNAMESDTRFFMPAFVEGCKGILKGIASLVDVGGGTCAAMSYVVKAFPHIKCAVLDLPHVIATSPEYPGVEMVAGDMFESIPPADAVLLKFMLHNWQNEGCVEILKKCKEAIPKDKGKVIIIDIVIDQDEEGNDLTNARIRLDVDMMATSGGRERTKEEWRVLMEMAGFSRHEIIPIFSVQSVIVAYY

SEQ ID NO: 1711 - protein, 357 aa, Tinospora cordifolia
MATKEGSSEVNYLGGLGLGRLICIPMALRAAVDLKVFEIIAEAGEEAHLSSSQIASKLPTTNPTAPIVLDRILRILGASSLLSVKIVKNQNDGHVRAYGLTSETRSLVPNKEQVSAVPMLLLVSDEAVVKSFYGLKHAVLEEGCVPFDKLHGMNFFEYAGKEDRVNKVFNDAMGVSSSIAFDEVFKVYQGFNEVEELLDVGGGIGTSLCKIVCKYPQISGINFELSHVVADAPPYPGVKHVAGNMFDGIPETQNIMLKWVLHDWGDEYCAKILKNCWNALPKGGKVIVVEFVLPPVLGNNVETFNSLIPDLIMLNLNPGGKERTLVEYEDLAKAAGFSEIKPFRISQGLHVLEFLKN

SEQ ID NO: 1712 - protein, 365 aa, Tinospora cordifolia
MTSTHTLPNSNHEEEEEEDCLLALQLASSAVLPMAFQTAIELQVLEIISKAGSGVYLSPKEIASQLPTQNPEAPSMLDRIMRLLAAYSLITSTVVTCDNGLVERKYGLAPVSKYFVSNQDGVSFSPIMFLVQDKVFMDSWYSLKDAVLEGGIPFNKVHGVHAFEYSGLDSRFNQVFNKAMFNHTTIIMKKILEVYKGFENLEELVDVGGGIGTVISIITSKYPTVKGINFDLPHVIESASVIPGVKHVGGDMFTGVPKGEAIFMKWILHDWSDEYCLKLLKNCYDALPSNGKLIVVEAIMPVTPKSNAAAKGLCQVDLVMLTQYAGGKERTEKEFEAMALGTGFAGIRKVCCVCNYWVMEFFKEI

SEQ ID NO: 1713 - protein, 366 aa, Tinospora cordifolia
MGSTQNQVSKFSSPEEEEEACLHAMQLASASVLPMVLRAAIELDVLEIIAKLSASGASGHVSVPEIVALLPSQKPEASKVMLDRMLRLLASYKILICSMGDNGERSYGLAPVAKFLVKNDDGVSMAPLVLMNQDKVLMESWYHLKDAVLDGGIPFNKAYGMTAFEYHGKDPRFNKVFNRGMSDHSTITMKKLLETYTGFNGLKSVVDVGGGIGATLNMIISKHPTIKGINFDLPHVTEDAPSYPGVEHVGGDMFVSVPKGDAIFMKWILHDWSDDHCAKFLKNCYESLPKDGKVIIVESILPEFPNTDLSANGSFQLDNIMLAHNPGGKERTAKDFEALAKRAGFAHFKVVCGAYNSWVMEFCKSL

SEQ ID NO: 1714 - protein, 364 aa, Tinospora cordifolia
MDLFKNQPKNYDEEEDCCQFALQLSSASVLPMVLKAVIELGVLEIIGRAGLGAQLSASEIVSSLPTKNPQATLMLERMLRLLASYSVLTNSLNYSENGEVLRFYGLGPVCKYFIGNNHGASLAPFLHLIQDKAIMESWYHLKDAVLEGGLPFTKAHDLNATDYLKKDSRFANLFKQYSVGNNVTTMKKILDNYKGFENLKELVDVGGGDGSVLDMIVSKYPSIKGINFDTPAVIEKAPFYPGVEHVAGDMFESVPKSNTIFMKCILHGWDDESCLKLLRNCYKALPDDGMVVAVEYVIPTTSESISRNNNIILYDAFMMTVNALKQKTLEEYEVIAKEAGFSGVKLICYACNYSVLEIYKNYVI

SEQ ID NO: 1715 - protein, 348 aa, Thalictrum flavum
MAAFQGKDESVDINAQAHVWKIIYGFADSLVLRCAVELGIFDIIDNNNQPITLADLASKLPISNVNLDNLFRILRYLVKMEILSYAGVNKYALEPIAKLVLRNEKRSMVPMVLGMTQKDFMTPWHSMKDGLTDNGVTAFEKAMGMTIWEYLEGHPDQSQLFNEGMAGETRLLTSSLISGSKDLFQSIDAVVDVGGGNGTTIKAISDAFPHIKCTLFDLPHVIANSYDHPNIERIGGDMFKGMPSAQAILLKLILHDWNDEDSIKILKQCRKAVPKDGGRVIIVDVALDEDSDHELSSTRLILDIDMLVNTGGKERTKEDWEKLVKCAGFSGCKIRHIAAIQSVIEIFP

SEQ ID NO: 1716 - protein, 341 aa, Thalictrum flavum
MEDLSSQAKLWNYIYGFADSLVLKCAVQLDLANLIHDHGTPMTLSELSSRLPSQPVNQDALYRVMRYLVHIKLFTKSSIDGELRYGLAPPAKFLVKGWDNCMIGSILLMVDTDFMALYHYIKDEILNDGSSITITAFEKALGTNIWEYLAEHPEKNQLFNEGMANESRLYCSSTFEGLTTLVDVGGGTGTTVKYIAKAFPNIKYTVYDLPHVIADAPGDTEINFVQGDMFKYIPNADAILMKGVLHDWDDNECIEILKRCKHAVPRDGGKVIIIDVVLNVKSEHPYTKMRLTLDLDMMLNNKGKERTEEDWKKLIYDDAGYKGYKITQISALQSVIEAYPY

SEQ ID NO: 1717 - protein, 382 aa, Thalictrum flavum
MYINAYSGMFGGRSRTLHRYMMEIMNEDASKELLEAQAHIWKYTFNYITTMSLRCAVQLGIPDIIYNHTKPITLSELVKALSIPQIRSPYVYRLMRMLVHSGFFAIEKIHEHLEEEEEKEGYTLTPSSRLLSKNNVTNLSPFLLIETDPAIVTPCHFMSALFQGSGCLPVEAAYGMSIWEYFLKNPEINKTFNDGMACDAQFLMTFVIQDCKTMFEGSKSLVDVGGGTGAAAKAISEAFPNMKCIVFDLPHVVSNLKGNENIEFVAGDMFESIPSTDMILLKWIMHDWSDEECVKILKKCRNAIPSKDQGGKVIIIDIVLLAEKGKYESTESQLCLDILMMVHATGKERTETEWEKLFLEAGFASYKITHALGLRSIIEVFP

SEQ ID NO: 1718 - protein, 350 aa, Thalictrum flavum
MEMINKENLSSQAQLWNFIYGFADSLVLKSAVQLDLANIIHNHGTPMTLSELSLRLPSQPVNQDALYRVLRYLVHMKLFTKSSIDGELRYGLAPPAKFLVKGWDKCMLGAILTITDKDFMAPWHYLKEGILNDGSTSTAFEKALGTNIWDYMAEHPEKNQLFNEGMANDTRLIMSALVKECSSIFEGITTLVDVGGGTGTAVRNIAKAFPHIKCTVYDLPHVIADSPGYTEINSVQGDMFKYIPNADAIMMKCILHDWDDKECIEILKRCKDAVPRDGGKVIIIDIILDVKSEHPYTKMRLTLDLDMMLNTGGKERTEEEWKKLIHVAGYKRYKITHISAVQSVIEAYPY

SEQ ID NO: 1719 - protein, 350 aa, Thalictrum flavum
MEMVNKENLSSQAQLWNFIYGFSDSLVLKCAVQLDLANIIHDHGSPMTLSELSSRLPSQPVNQDALYRVMRYLVHMQLFTESSIHGEMRYGLAPPAKFLIKGWDYCMIDDILALLDKDYMAPWHHLKDGLSSDGGSPTPFEKVMGTNIWDYMAERPENNHQFNEGMAKDTRLTMSALLKECSSVFEGITTLVDVGGGTGTAVRYIAKAFPHIKCTVYDLPHVIADSPGDTEINFVEGDMFKCIPNADAILLKCILHDWNDNECIKILKRCKDAVPRDGGKVIIIDIILDVKSEHPYTKMRLLCDLGMMLDGGKERTEEEWKKLIHDDAGYKGYKITQISAFQSVIEAYPY

SEQ ID NO: 1720 - protein, 358 aa, Thalictrum flavum
MATITPNTVLKPFEKDEIEAQALVWKHMYGFADTIMLRTVVSLGIPDIVYNHHGPITLSQLATQLSIDSIRNDRLNIFMRYAVHMNLFKISTDEITKESRYELTHASKILVKSHNKSLASYVMLQTDSEEFSIWGHVVDCLEGKISYLESTYGNLYEALEKGPESDIELFNDAMTSHSRFMLPALVSGLVKEKVLDGVGSIVDVGGGSGVTAKAIVHAFPHIKCSVMDLNHAIDSVVKDPKIDFVAGDMFTSIPNAEAILLKSTLHNHGDDDCHKILSNAKQAIPSVGGKVILVDIVVDIEGLPEFSSARLSMEMEMMFMGGKERTKQEWETLLSKAGFSHHKIIPILAIESIIVAYA

SEQ ID NO: 1721 - protein, 362 aa, Thalictrum flavum
MGSTQKNHNLTPEEEEEACVHAMQLASASVLPMVLKAAIELDVLEIIAKAGQGAYVAPTEIASQLSTSNSQAPIILDRILRLLASYKVLTCNLRTLEDGGVERLYGLAPVCKFLVKNEDGVSIAPLVLMNQDKVLMESWYHLKDAVLDGGIPFNKAYGMTAFEYHGTDPRFNKVFNRGMADHSTITMKKLLELYKGFEGLKSVVDVGGGTGATINMIVTKHPTIKGINFDLPHVIDDAPAYPGVEHIGGDMFVSVPKGDAIFMKWILHDWSDEHSVKFLKNCYESIPADGKVIIVESILPVYPETNLASNACFQLDNIMLAHNPGGKERTEKDFEALSAKAGFTGFKIVCGAFGSWVMEFCK

SEQ ID NO: 1722 - protein, 355 aa, Thalictrum flavum
MALQEGVNYLSGLGLSRLICLPMALRAAIELNVFEIIFQAGPEAQLSPAEIVAKIPTKNPNAAIALDRILRMLGASSILSVTTMKDGRVYGLTEESRCLVADKNGVSVVPMLLFTSDKAVVESFYNIKDVVLEEGVIPFDRTHGMDFFAYAGKEQSVNKSFNQAMGAGSTIAFDEVFKVYKGFHDLKELVDVGGGIGTSLSNIISKYPHIKGINFELPHVIADAPNYPGVEHIAGNMFEGVPNAQNILLKWVLHDWDDERSIKILQNCWKALPEGGTVIVVEFVLPQILGNNAESFNALTPDLLMMTLNPGGKERTTTEFDGLAKAAGFAETKFFPISQGLHVMEFHKATAGVAS

SEQ ID NO: 1723 - protein, 350 aa, Xanthoriza simplicissima
MAFHGKDDALDIKAQAHVWKIIYGFADSLVLRCAVELGIVDIIDNNNQPIALADLASKLPVSNVNCDNLYRILRYLVKMEILRLENSDDGEKKYALEPIATLLSRNAKRSMVPMILGMTQKDFMTPWHSMKDGLSDDGTAFEKAMGMTIWEYLEGHPDQSQLFNEGMAGETRLLTSSLISGSRDMFQGIDSLVDVGGGNGTTIKAISDAFPHIKCTLFDLPHVIANSYDHPNIERIGGDMFKSVPSAQAILLKLILHDWNDEDSIKILKQCRNAVPKDGGKVIIVDVALDEESDHELSSTRLILDIDMLVNTGGKERTKEVWEKIVKSAGFSGCKIRHIAAIQSVIEVFP

SEQ ID NO: 1724 - protein, 354 aa, Xanthoriza simplicissima
EIIKGDGTKEVLEAQAHIWNYTFNYITSMSLRCAVQLGIPDIIDNHDKPVTLSELVKALSFPQVKSAHVYRLMRVLVHSGFFTVGKIHEQEEEYMLTPSSKLLMKNHVTNLAPFLLMITDPVIANSCHFMTSLFQGSEVLPIEVAHGMSLWNYCNQHPEFNQLFNDAMASDTNFVLSVVVKEYKAIFEGFRSLVDVGGGIGTAAKAISKALPHLRCTVLDLPHVVSNMVGNANIEFVSGDMFKYVPPADIVLLKWIMHDWNDEECVKILQRCREALPAKEKGGKVIIIDVVVDCNKGKFETTEAQLCFDILMMVCLTGKERTEKEWEKLFMESGFTSYKITHGLGLRSIIEVFP

SEQ ID NO: 1725 - protein, 356 aa, Xanthoriza simplicissima
MEITNGDETNELLEAQAHIWNHTFNYITSMSLKCAVQLGIQDIIFTHDKPLTLSELTKALSIPEIKAAHIFRLMRILVHTGFFGVEKIHEDEEGYVLTPSSKLLLKTHETNLSPFLLMMIDPVFVTPFHFMSAWIQGNDSTPFVAAFGMEIWDYFGQHLDTTNKFFNSAMASDAAFVMSVVVKDCKSMFEGFRSLVDVGGGTGTMAKAISKAFPHLRCTNFDLPHVISNMQRSKNLDFIGGDMFESVPSADIILLKWIMHDWSDEECVKILKRCREAIPLKDKEGKIIIIDIVMDDKNGKHESIETQLCFDMLMMSLATGKERTVIEWEKLFLESGFRSYKITHCLGLRSIIEVFP

SEQ ID NO: 1726 - protein, 347 aa, Xanthoriza simplicissima
MEVKKDNLSSQAKLWNFIYGFAESLVLKCAVQLDLANIIHNNGTPMTLSELSLHLPNQPVNEDALYRIMRYLVHMKLFTKESIDGELRYGLAPPAKFLVKGWDKCMVGSILAITDKDFMAPWHYLKDGLSGESGTAFEMALGKNIWEYMAEHPEKNQLFNEAMANDSRLIMSALVKECGYIFKGITTLVDVGGGTGTAVRNIAKAFPHIKCTVYDLPHVIADSPGYSEVHCVEGDMFKFIPKADAIMMKCILHDWDDKECIEILKRCKEAVPIEGGKVIIVDIVLNVESEHPYTKMRLTLDLDMMLNTGGKERTEEEWKNLIHDAGYKGYKITPITAVQSVIEAYPY

SEQ ID NO: 1727 - protein, 356 aa, Xanthoriza simplicissima
MMQIQEEEQEQDMKSHAQILNHMCGIVDSVVLKCAIELSLFDIISNNKDNKPITLSSLATSPTLVSIKPNNLYRLLRYLVHMNLLTIHVVEGNETFSLTELSKLLLRDQKRSLVGWALAIIDETVIDGWHELSDCCTSPAGAPTPFERVHGKSVWELAGENAGMNQVINDAMVSDTILVMPVFVQCCDKLLNGITSIVDIGGGVGMAMSYIVKAFPHIKCTVFDLPHVIAASAQLPGVEMVGGDMFKCIPPADAIFLKFMLHNWQDKECIKILKKCKEAIPQEKGKVIILDIVTDKDEEDDDLTRAKMNLDIDMMVISGGRERTKNEWQVLLNLAGFSRHEIIPIMAVQSVIVAYP

SEQ ID NO: 1728 - protein, 361 aa, Xanthoriza simplicissima >
MGSTQNSINLTPQEEEEACLHAMQLASASVLPMVLRAAIELDVLEVIAKAGQGACITPSEIASKLSTTNTHASVMLDRILRLLASYKVLSCNLRTLEDGGVERSYGLAPVCKFLTKNEDGVSMAPLVLMNQDKVLMESWYLKDAVLDGGIPFNKAYGMTAFDYHGTDPRFNKVFNRGMSDHSTITMKKILEMYKGFDGLKTLVDVGGGTGATINMIVKKHPSIKGINFDLQHVIEDAPTYPGIEHIGGDMFVSVPKGDAIIMKWILHDWSDEHSLKFLKNCYESLPANGKVIIVESILPEFPETNLAANGAFQLDNIMLAHNPGGKERTEKDFESLSGGAGFADFKVVCCAFNSWVMEFCK

SEQ ID NO: 1729 - protein, 340 aa, Xanthoriza simplicissima
MQLTGAAALPMVMRVAIDLDVFEIIAKAGPGVQLSSKSIASYLPTQNPDAHKMIDRILRLLASYSVLKSSLVTGDDGLAERLYGLEPVCKYFVRDEDGVSVSPFMLLVQDKVFIDSWFHLKDAVLEGGIPFNKAHGMHAFEYPGIDPKFNKVFNRAMFSHTTIVVKKILEVYRGFEDLKEVVDVGGGLGTTLGIITSKYPAIKGINFDLPHVVEHAPSYPGVEHVGGSMFDSVPSGETIFMKWILHDWSDEECIKLLKNCYKALPEHGKLIVVDAILPVAPESDSAAKSLCQLDVSMMTQNPGGKERTEEEFEILAKGAGFTTINKACCVYNYWVMEFHK

SEQ ID NO: 1730 - protein, 351 aa, Xanthoriza simplicissima
MAAKDGVNYLSGLGLSRLICLPMALRAAIELNVFEIISQAGPDAYLSPSDIVAKIPTKNPSAAISLDRILRMLGASSILSVSTTKSGRVYGLNEESRCLVAPDDKVSVVPMLLFTSDKAVVESFYNIKDVVLEEGVIPFDRTHGMDFFQYAGKEQRVNKSFNQAMGAGSTIAFDEVFKVYKGFDNLKELVDVGGGIGTSLSNIVAKYPHIRGINFELPHVIGDAPDYPGVEHVPGDMFEGVPNAQNILLKWVLHDWDDDRSIKILKNCWKALPENGTVIVIEFVLPQVLGNNAESFNALTPDLLMMALNPGGKERTTIEFDGLAKTAGFAETKFFPISQGLHVMEFHKVKC

SEQ ID NO: 1731 - protein, 350 aa, CJA4OMT
MAFHGKDDVLDIKAQAHVWKIIYGFADSLVLRCAVELGIVDIIDNNNQPMALADLASKLPVSDVNCDNLYRILRYLVKMEILRVEKSDDGQKKYALEPIATLLSRNAKRSMVPMILGMTQKDFMTPWHSMKDGLSDNGTAFEKAMGMTIWEYLEGHPDQSQLFNEGMAGETRLLTSSLISGSRDMFQGIDSLVDVGGGNGTTVKAISDAFPHIKCTLFDLPHVIANSYDLPNIERIGGDMFKSVPSAQAIILKLILHDWNDEDSIKILKQCRNAVPKDGGKVIIVDVALDEESDHELSSTRLILDIDMLVNTGGKERTKEVWEKIVKSAGFSGCKIRHIAAIQSVIEVFP

SEQ ID NO: 1732 - protein, 347 aa, CJA6OMT
MEVKKDNLSSQAKLWNFIYGFAESLVLKCAVQLDLANIIHNSGTSMTLSELSSRLPSQPVNEDALYRVMRYLVHMKLFTKASIDGELRYGLAPPAKYLVKGWDKCMVGSILAITDKDFMAPWHYLKDGLSGESGTAFEKALGTNIWGYMAEHPEKNQLFNEAMANDSRLIMSALVKECGNIFNGITTLVDVGGGTGTAVRNIANAFPHIKCTVYDLPHVIADSPGYSEVHCVAGDMFKFIPKADAIMMKCILHDWDDKECIEILKRCKEAVPVKGGKVIIVDIVLNVQSEHPYTKMRLTLDLDMMLNTGGKERTEEEWKKLIHDAGYKGHKITQITAVQSVIEAYPY

SEQ ID NO: 1733 - protein, 351 aa, CJASOMT
MDTPNTFQNDDEIKAQAQVWKHMFGFAETIMLRSTVSLGIPDIIHNNGPVTLSQLVTHLPLKSTSIDRFHHFMRYLVHMQLFTISTDQITKEDKYELTPASKLLVHGHQKSLAPYVMLQTHPEEFSVWSHVINVLDGKKPYWESNDTSMYEKTEGDPEINEILNDAMTSHSTFMLPALVSGLMKENVLDGVASIVDVGGNSGVVAKGIVDAFPHVKCSVMDLNHVIERVIKNPKLDYVAGDMFTSIPNADAILLKSTLHNYEDDDCIKILNIAKEALPSTGGKVILVEIVVDTENLPLFTSARLSMGMDMMLMSGKERTKKEWEDLLRKANFTSHQVIPIMAIESIIVAYS

SEQ ID NO: 1734 - protein, 381 aa, CJASOMT
MCTSLSELKCPVFSTKRKLLLEFALRTSVDMAAQEGVNYLSGLGLSRLICLPMALRAAIELNVFEIISQAGPDAQLSPSDIVAKIPTKNPSAAISLDRILRMLGASSILSVSTTKSGRVYGLNEESRCLVASEDKVSVVPMLLFTSDKAVVESFYNIKDVVLEEGVIPFDRTHGMDFFQYAGKEERVNKSFNQAMGAGSTIAFDEVFKVYKGFDNLKELVDVGGGIGTSLSNIVAKHPHIRGINFELPHVIGDAPDYPGVEHVPGDMFEGVPNAQNILLKWVLHDWDDDRSIKILKNCWKALPENGTVIVIEFVLPQVLGNNAESFNALTPDLLMMALNPGGKERTTIEFDGLAKAAGFAETKFFPISQGLHVMEFHKINC

SEQ ID NO: 1735 - protein, 353 aa, Eschscholzia californica; identical to SEQ ID NO: 1580

SEQ ID NO: 1736 - protein, 351 aa, Eschscholzia californica
MEMEGADKIDQATQAKIWKHIYGFAESLILKSAVELEIADTIHNHGKPMTLSELASKLPVQPVDLDRLYRVMRYLVHMKLFKKQEDEDEESIKYSLLPPAKFLIKGWEKSMVSAILLINDKDFMSPWHHLKEGLVNNSNAFDKALGKSIWDYMSANPDKNKVFNEGMACDSRLVSSALVNECGNIFQGIQTLVDVGGGTGTAVKAVSKAFPHIKCSIYDLPHVISDSPDIPNIVKIEGEMFKSIPSADAILMKCILHDWNDDECIEILKKCKEAVPKEGGKVIIVDIVLDMESKHPYSKVRLTLDLDMMLNTEGKERTEEEWKKLIDGAGFASYKITQISALQSVIEAFPY

SEQ ID NO: 1737 - protein, 353 aa, Eschscholzia californica
MDEEIILGQADICKYMYGFVDSMTLRCVVELGIPDIIHSHGRPITLTEILNGIPNLSSSFDINYLQGIMTILVRRRVFAVHKFDPKDGTNLTEIRYGLTPSSKCLLKDSKFNLAPFVLLETHPWITDPWNYLGKCVQEGGSGFVKAHGSDVFKFGSDHPEFFKLFYDGMECSTKVLVQVVLDKYQQVFKDVKSIVDVGGGTGMMISEIVKNHPHIKGINFDLPHVVAEAPDYPGVEHVGGDMFVEIPQADAITMKGILHDWNDDACVKILENCKKAIPKNGKVIIIDCVLNPDGDDLFDDIKVVSDLGMRVHCSDGKERTEAEWEKLLKKGGFPRYKITHVVTVQSMIEAYPE

SEQ ID NO: 1738 - protein, 354 aa, PSO4OMT1
MGSSIDAETHEVDIKDQAQLWNIIYGYADSLVLRCTVEIGIADIIKNNNGSITLSELVSKLPLSNVNSDNLYRLLRYLVHLNILGQQTCAAGVDRVYSLKPVGTLLLKDSERSMAPVILGLSQKDFLFVWNFVKEGLGTGSTTAFEKAMGMDMWKYLEVNPNQSQLFDEGQAGETRLLTKTLLVDCRDTFQGMDSLVDVGGGNGTTIKAIHEAFPHIKCTLYDLPHVIANSDDHPNILKVPGDMFMSVPSAQVLLLKCVLHDWTDEHCVNILKKCKEAIPKETGKVIIVDVALEEESEHELTKARLILDIDMLVNTGGRERTAEDWENLLKRAGFRSHKIRPIRAIQSVIEAFP

SEQ ID NO: 1739 - protein, 357 aa, PSO4OMT2
MGSLDAKPAAATQEVSIKDQAQLWNIIYGFADSLVLRCAVEIGIADIIKNNDGAITLAQLAAKLPITNVSSDYLYRMVRYLVHLNIIEQETCNGGVEKVYSLKPVGTLLLRDAERSMVPMILGMTQKDFMVSWHFMKEGLGNGSTTAFEKGMGMDIWKYLEGNPDQSQLFNEGMAGETRLLTKTLIEDCRDTFQGLDSLVDIGGGNGTTIKAIYEAFPHIKCTLYDLPHVVANSHDLPNIEKVPGDMFKSVPSAQAILLKLILHDWTDEECVNILKKCKEAIPKETGKVIIVDVALEEESNHELTKTRLILDIDMLVNTGGRERTADDWENLLKRAGFRSHKIRPIRAIQSVIEAFP

SEQ ID NO: 1740 - protein, 346 aa, PSO6OMT
METVSKIDQQNQAKIWKQIYGFAESLVLKCAVQLEIAETLHNNVKPMSLSELASKLPVAQPVNEDRLFRIMRYLVHMELFKIDATTQKYSLAPPAKYLLRGWEKSMVDSILCINDKDFLAPWHHLGDGLTGNCDAFEKALGKSIWVYMSVNPEKNQLFNAAMACDTRLVTSALANECKSIFSDGISTLVDVGGGTGTAVKAISKAFPDIKCTIYDLPHVIADSPEIPNITKISGDMFKSIPSADAIFMKCILHDWNDDECIQILKRCKEALPKGGKVIIVDVVIDMDSTHPYAKIRLTLDLDMMLNTGGKERTKEEWKTLFDAAGFASHKVTQISAVQSVIEAYPY

SEQ ID NO: 1741 - protein, 355 aa, PSO7OMT
MDTAEERLKGQAEIWEHMFAFVDSMALKCAVELGIPDIINSHGRPVTISEIVDSLKTNTPSSSPNIDYLTRIMRLLVHKRLFTSELHQESNQLLYNLTRSSKWLLKDSKFNLSPLVLWETNPILLKPWQYLGKCAQEKSSPFERAHGCEIWDLALADPKFNNFLNGAMQCSTTTIINEMLLEYKDGFSGIAGSLVDVGGGTGSIIAEIVKAHPHIQGINFDLPHVVATAAEFPGVKHVGGDMFVDIPEADAVIMKWILHDWSDEDCTIILKNCYRAIRKKKNGKVIIVDCVLRPDGNDLFDKMGLIFDVLMMAHTTAGKERTEAEWKILLNNAGFPRYNVIRTPAFPCIIEAFPE

SEQ ID NO: 1742 - protein, 357 aa, PSON7OMT
MEVVSQIDQENQAIIWKQIYGFSESLLLKCAVQCEIAETIHNHGTPMSILELAAKLPIDQPVNIDRLYRVMRYLVHQKLFNKEVISTLNGGTVQVTEKYWLAPPAKYLIRGSQQSMVPSVLGIIDEDMFAPWHILKDSLTGECNIFETALGKSISVYMSENPEMNQISNGAMAFDSGLVTSHLVNECKSVFGDEIKTLVDVGGGTGTALRAISKAFPNIKCTLFDLPHVIADSPEIPTITKVSGDMFKSIPSADAIFMKNILHDWNDDECIQILKRCKDVVSAGGKLIMVEMVLDEDSFHPYSKLRLTSDIDMMVNNGGKERTEKEWEKLFDAAGFASCKFTQMSVGFAAQSIIEVY

SEQ ID NO: 1743 - protein, 390 aa, PSOSOMT
MATNGEIFNTYGHNRQTATVTKITASNESSNGVCYLSETANLGKLICIPMALRAAMELNVFQLISKFGTDAKVSASEIASKMPNAKNNPEAAMYLDRILRLLGASSILSVSTTKKSINRGGDDVVVHEKLYGLTNSSCCLVPRQEDGVSLVEELLFTSDKVVVDSFFKLKCVVEEKDSVPFEVAHGAKIFEYAATEPRMNQVFNDGMAVFSIVVFEAVFRFYDGFLDMKELLDVGGGIGTSVSKIVAKYPLIRGVNFDLPHVISVAPQYPGVEHVAGDMFEEVPKGQNMLLKWVLHDWGDERCVKLLKNCWNSLPVGGKVLIIEFVLPNELGNNAESFNALIPDLLLMALNPGGKERTISEYDDLGKAAGFIKTIPIPISNGLHVIEFHK

SEQ ID NO: 1744 - protein, 356 aa, PSOSOMT2
  misc_feature (122)..(122): Xaa can be any naturally occurring amino acid
MEIHLESQEQEMKYQSQIWNQICGTVDTSVLRCAIQLGIFDAIHNSGKPMITLTELSSIVSSPSSSSIEPCNLYRLVRYLSQMDLISIGECLNEATVSLTGTSKLLLRNQEKSLIDWVLAIXCEMMVVVWHELSSSVSTPADEPPIFQKVHGKNALELAGEFPEWNDLINNAMTSDTSVTKPALIQGCGKILNGVTSLIDVGGGHGATMAYIVEAFPHIKGAVIDLPHVVEAAPERPGVEFISGDIFKSISNADAVLLKYVLHNWEDTECVNLLKRCKEAVPADKGKVIIMDLVIDDDDNSILTQAKLSLDLTVMNHGGGRERTKEDWRNLIEMSGFSRHEIIPISAMPSIIVAYP

SEQ ID NO: 1745 - protein, 339 aa, PSOSOMT3
MEVVSKIDQENQAKIWKQIFGFAESLVLKCAVQLEIAETLHNNVKPMSLSELASKLPAQPVNEDRLYRILHFLVHMKLFNKDATTQKYSLAPPAKYLLKGWEKSMVPSILSVTDKDFTAPWNHLGDGLTGNCNAFEKALGKGIRVYMRENPEKDQLFNEGMACDTRLFASALVNECKSIFSDGINTLAGVGRGTGTAVKAISKAFPDIKCTIHDLPEVTSKNSKIPRDVFKSVPSADAIFMKSILHEWNDEECIQILKRCKEAIPKGGKVIIADVVIDMDSTHPYSKSRLAMDLAMMLHTGGKERTEEDWKKLIDAAGFASCKITKLSALQSVIEAYPH

SEQ ID NO: 1746 - protein, 348 aa, Thalictrum flavum
MAAFQGKDASVDIKAQAHVWKIIYGFADSLVLRCAVELGIFDIIDNNNQPIPLADLASKLPISNVNLDNLFRILRYLVKMELLSYAADDKYALEPIAKLVLRNEKRSMVPMVLGMTQKDFMTPWHSMKDGLTDNGVTAFEKAMGMTIWEYLEGHPDQSQLFNEGMAGETRLLTSSLISGSKDMFQSIDSLVDVGGGNGTTIKAISVAFPHIKCTLFDLPHVIANSYDHPNIERIGGDMFKGMPSAQAILLKLILHDWNDEDSIKILKQCRKAVPKDGGKVIIVDVALDEDSDHELSSTRLILDIDMLVNTGGKERTKEDWEKLVKCAGFSGCKIRHIAAIQSVIEVFP

SEQ ID NO: 1747 - protein, 350 aa, Thalictrum flavum
MEMINKENLSSQAKLWNFIYGFADSLVLKSAVQLDLANIIHNHGSPMTLSELSLHLPSQPVNQDALYRVLRYLVHMKLFTKSSIDGELRYGLAPPAKFLVKGWDKCMLGAILTITDKDFMAPWHYLKEGILNDGSTSTAFEKALGTNIWDYMAEHPEKNQLFNEGMANDTRLIMSALVKECSSMFDGITTIVDVGGGTGTAVRNIAKAFPHIKCTVYDLPHVIADSPGYTEINSIQGDMFKYIPNADAIMMKCILHDWDDKECIEILKRCKDAVPRDGGKVIIIDIILDVKSEHPYTKMRLTLDLDMMLNTGGKERTEEEWKKLIHDAGYKGYKITHISAVQSVIEAYPY

SEQ ID NO: 1748 - protein, 355 aa, Thalictrum flavum
MALQEGVNYLSGLGLSRLICLPMALRAAIELNVFEIIFQAGPEAQLSPAEIVAKIPTKNPNAAIALDRILRMLGASSILSVTTMKDGRVYGLTEESRCLVADKNGVSVVPMLLFTSDKAVVESFYNIKDVVLEEGVIPFDRTHGMDFFAYAGKEQSVNKSFNQAMGAGSTIAFDEVFKVYKGFHDLKELVNVGGGIGTSLSNIIFKYPHIKGINFELPHVIADAPNYPGVEHIAGNMFEGVPNAQNILLKWVLHDWDDERSIKILQNCWKALPEGGTVIVVEFVLPQILGNNAESFNALTPDLLMMTLNPGGKERTTTEFDGLAKAAGFAETKFFPISQGLHVMEFHKATAGVAS

SEQ ID NO: 1749 - protein, 358 aa, CjCNMT
MAVEAKQTKKAAIVELLKQLELGLVPYDDIKQLIRRELARRLQWGYKPTYEEQIAEIQNLTHSLRQMKIATEVETLDSQLYEIPIEFLKIMNGSNLKGSCCYFKEDSTTLDEAEIAMLDLYCERAQIQDGQSVLDLGCGQGALTLHVAQKYKNCRVTAVTNSVSQKEYIEEESRRRNLLNVEVKLADITTHEMAETYDRILVIELFEHMKNYELLLRKISEWISKDGLLFLEHICHKTFAYHYEPLDDDDWFTEYVFPAGTMIIPSASFFLYFQDDVSVVNHWTLSGKHFSRTNEEWLKRLDANLDVIKPMFETLMGNEEEAVKLINYWRGFCLSGMEMFGYNNGEEWMASHVLFKKK

The invention claimed is:

1. A method of producing sanguinarine in a yeast host cell, the method comprising:
   (a) providing a yeast host cell that expresses the enzymes *Papaver somniferum* 6-O-methyltransferase (6OMT), *Papaver somniferum* coclaurine-N-methyltransfersase (CNMT), *Papaver somniferum* 4'-O-methyltransferase 2 (4'OMT2), *Papaver somniferum* berberine bridge enzyme (BBE), cheilanthifoline synthase (CFS), *Papaver somniferum* stylopine synthase (SPS), *Papaver somniferum* tetrahydroprotoberberine cis-N-methyltransfersase (TNMT), *Papaver somniferum* (S)-cis-N-methylstylopine-14-hydroxylase (MSH), *Papaver somniferum* protopine 6-hydroxylase (6PH) and *Papaver somniferum* dihydrobenzoreductase (DBOX), and wherein the cheilanthifoline synthase is encoded by SEQ ID NO: 262, and
   (b) growing the yeast cell to produce sanguinarine.

2. A method of producing sanguinarine in a yeast host cell, the method comprising:
   (a) providing a yeast cell that expresses the enzymes *Papaver somniferum* 6-O-methyltransferase (6OMT), *Papaver somniferum* coclaurine-N-methyltransfersase (CNMT), *Papaver somniferum* 4'-O-methyltransferase 2 (4'OMT2), *Papaver somniferum* berberine bridge enzyme (BBE), *Papaver somniferum* cheilanthifoline synthase (CFS), stylopine synthase (SPS), *Papaver somniferum* tetrahydroprotoberberine cis-N-methyltransfersase (TNMT), *Papaver somniferum* (S)-cis-N-methylstylopine-14-hydroxylase (MSH), *Papaver somniferum* protopine 6-hydroxylase (6PH) and *Papaver somniferum* dihydrobenzoreductase (DBOX), and wherein the stylopine synthase (SPS) is encoded by SEQ ID NO: 264, and
   (b) growing the yeast cell to produce sanguinarine.

3. A method of producing sanguinarine in a yeast host cell, the method comprising:
   (a) providing a yeast host cell that expresses the enzymes *Papaver somniferum* 6-O-methyltransferase (6OMT), *Papaver somniferum* coclaurine-N-methyltransfersase (CNMT), *Papaver somniferum* 4'-O-methyltransferase 2 (4'OMT2), *Papaver somniferum* berberine bridge enzyme (BBE), cheilanthifoline synthase (CFS), stylopine synthase (SPS), *Papaver somniferum* tetrahydroprotoberberine cis-N-methyltransfersase (TNMT), *Papaver somniferum* (S)-cis-N-methylstylopine-14-hydroxylase (MSH), *Papaver somniferum* protopine 6-hydroxylase (6PH) and *Papaver somniferum* dihydrobenzoreductase (DBOX), and wherein the cheilanthifoline synthase (CFS) is encoded by SEQ ID NO: 262 and the stylopine synthase (SPS) is encoded by SEQ ID NO: 264, and
   (b) growing the yeast cell to produce sanguinarine.

4. The method according to claim 1, wherein the yeast cell is a *Saccharomyces* cell.

5. The method according to claim 2, wherein the yeast cell is a *Saccharomyces* cell.

6. The method according to claim 4, wherein the *Saccharomyces* cell is a *Saccharomyces cerevisiae* cell.

7. The method according to claim 5, wherein the *Saccharomyces* cell is a *Saccharomyces cerevisiae* cell.

8. The method according to claim 3, wherein the yeast cell is a *Saccharomyces* cell.

9. The method according to claim 8, wherein the *Saccharomyces* cell is a *Saccharomyces cerevisiae* cell.

10. A method of producing sanguinarine in a *Saccharomyces cerevisiae* cell, the method comprising:
    (a) providing a *Saccharomyces cerevisiae* cell that expresses the enzymes 6-O-methyltransferase (6OMT), coclaurine-N-methyltransfersase (CNMT), 4'-O-methyltransferase 2 (4'OMT2), berberine bridge enzyme (BBE), cheilanthifoline synthase (CFS), stylopine synthase (SPS), tetrahydroprotoberberine cis-N-methyltransfersase (TNMT), (S)-cis-N-methylstylopine-14-hydroxylase (MSH), protopine 6-hydroxylase (6PH) and dihydrobenzoreductase (DBOX), and wherein the cheilanthifoline synthase (CFS) is encoded by SEQ ID NO: 262 and is non-homologous to the other enzymes, and
    (b) growing the *Saccharomyces cerevisiae* cell to produce sanguinarine wherein sanguinarine is produced in the cell at a level that is in excess of the level of sanguinarine produced when a homologous CFS is used.

11. A method of producing sanguinarine in a *Saccharomyces cerevisiae* cell, the method comprising:
    (a) providing a *Saccharomyces cerevisiae* cell that expresses the enzymes 6-O-methyltransferase (6OMT), coclaurine-N-methyltransfersase (CNMT), 4'-O-methyltransferase 2 (4'OMT2), berberine bridge enzyme (BBE), cheilanthifoline synthase (CFS), stylopine synthase (SPS), tetrahydroprotoberberine cis-N-methyltransfersase (TNMT), (S)-cis-N-methylstylopine-14-hydroxylase (MSH), protopine 6-hydroxylase (6PH) and dihydrobenzoreductase (DBOX), and wherein the stylopine synthase (SPS) is encoded by SEQ ID NO: 264 and is non-homologous to the other enzymes, and
    (b) growing the *Saccharomyces cerevisiae* cell to produce sanguinarine wherein sanguinarine is produced in the cell at a level that is in excess of the level of sanguinarine produced when a homologous SPS is used.

12. A method of producing sanguinarine in a *Saccharomyces cerevisiae* cell, the method comprising:
    (a) providing a *Saccharomyces cerevisiae* cell that expresses the enzymes 6-O-methyltransferase (6OMT), coclaurine-N-methyltransfersase (CNMT), 4'-O-methyltransferase 2 (4'OMT2), berberine bridge enzyme (BBE), cheilanthifoline synthase (CFS), stylopine synthase (SPS), tetrahydroprotoberberine cis-N-methyltransfersase (TNMT), (S)-cis-N-methylstylopine-14-hydroxylase (MSH), protopine 6-hydroxylase (6PH) and dihydrobenzoreductase (DBOX), and wherein the cheilanthifoline synthase is encoded by SEQ ID NO: 262 and the stylopine synthase (SPS) is encoded by SEQ ID NO: 264 and both the CFS and SPS are non-homologous to the other enzymes, and (b) growing the *Saccharomyces cerevisiae* cell to produce sanguinarine wherein sanguinarine is produced in the cell at a level that is in excess of the level of sanguinarine produced when a homologous CFS and SPS is used.

\* \* \* \* \*